United States Patent 12,508,308 (INFLUENZA mRNA VACCINES) - sequence listing, part 10

SEQ ID NO: 40616 - RNA, 1701 nt, Artificial Sequence
  hemagglutinin__InfluenzaA__AGO02697
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaagaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacauuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 40617 - RNA, 1701 nt, Artificial Sequence
  hemagglutinin__InfluenzaA__AGO02698
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuacugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40618 - RNA, 1701 nt, Artificial Sequence; identical to SEQ ID NO: 40362
  hemagglutinin__InfluenzaA__AGO02699

SEQ ID NO: 40619 - RNA, 1701 nt, Artificial Sequence
  hemagglutinin__InfluenzaA__AGO02700
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuggaagacaagcauaacgggaaacuaugcaaacugagagggguagccccauugcauuuggguaaauguaacauugcuggcuggauccugggaaauccagagugugaaucacucuccacagcaagcucaugguccuacaucguggaaacaucuaguucagacaauggaacgugcuacccaggagauuucaucaauuaugaggagcuaagagagcaauugagcucagugucaucauuugaaagguuugagauauuccccaagacaaguucauggcccaaucaugacucgaacaaagguguaacggcagcauguccucaagcuggagcaaaaagcuucuacaaaaauuuaauauggcuaguuaaaaaaggaaauucauacccaaagcucagcaaauccuacauuaacgauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaguaagacccaaagugagggaucaagaagggagaaugaacuauuacuggacacuaguagagccgggagacaaaauaacauucgaagcaacuggaaaucuauugguaccaagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaaugucccaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugcgcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaagauacucagaggaagcaaaauuaaacagagaagaaauagaugggauaaagcuagaaucaacaaggauuuaccagauuuuggcgaucuauucaacugucgccaguucauugguacugauagucucccugggggcaaucaguuucuggaugugcucuaaugggucucuacaguguagaauauguauuuaa

SEQ ID NO: 40620 - RNA, 1701 nt, Artificial Sequence
  hemagglutinin__InfluenzaA__AGO02701
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuuuuagaagacaagcauaacgggaaacuaugcaaacugagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaagagcuaagagagcaauugagcucagugucacauuuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaacgauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaguaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugggcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40621 - RNA, 1683 nt, Artificial Sequence
  hemagglutinin__InfluenzaA__AGO51374
augaacacucaaauccugguauucgcucugauugcgaucauuccaacaaaugcagacaaaaucugccucggacaucaugccgugucaaacggaaccaaaguaaacacauuaacugaaagaggaguggaagucgucaaugcaacugaaacaguggaacgaacaaacauccccaggauuugcucaaaagggaaaaggacaguugaccucggucaauguggacuccuggggacaaucacuggaccaccucaaugugaccaauuccuagaauuuucagccgauuuaauuauugagaggcgagaaggaagugaugucuguuauccugggaaauucgugaaugaagaagcucugaggcaaauucucagagaaucaggcggaauugacaaggaagcaaugggauucacauacaguggaauaagaacuaauggagcaaccagugcauguaggagaucaggaucuucauucuaugcagaaaugaaauggcuccugucaaacacagauaaugcugcauucccgcagaugacuaagucauauaaaaauacaagaaaaagcccagcucuaauaguaugggggauccaucauuccguaucaacugcagagcaaaccaagcuauaugggaguggaaacaaacuggugacaguugggaguucuaauuaucaacaaucuuuuguaccgaguccaggagcgagaccacaaguuaauggucuaucuggaagaauugacuuucauuggcuaaugcuaaaucccaaugauacagucacuuucaguuucaauggggcuuucauagcuccagaccgugcaagcuuccugagaggaaaaucuaugggaauccagaguggaguacagguugaugccaauugugaaggggacugcuaucauaguggagggacaauaauaaguaacuugccauuucagaacauagauagcagggcaguuggaaaauguccgagauauguuaagcaaaggagucugcugcuagcaacagggaugaagaauguuccugagauuccaaagggaagaggccuauuuggugcuauagcggguuucauugaaaauggaugggaaggccuaauugaugguugguaugguuucagacaccagaaugcacagggagagggaacugcugcagauuacaaaagcacucaaucggcaauugaucaaauaacaggaaaauuaaaccggcuuauagaaaaaaccaaccaacaauuugaguugauagacaaugaauucaaugagguagagaagcaaaucgguaaugugauaaauuggaccagagauucuauaacagaaguguggucauacaaugcugaacucuugguagcaauggagaaccagcauacaauugaucuggcugauucagaaauggacaaacuguacgaacgagugaaaagacagcugagagagaaugcugaagaagauggcacugguugcuuugaaauauuucacaagugugaugaugacuguauggccaguauuagaaauaacaccuaugaucacagcaaauacagggaagaggcaaugcaaaauagaauacagauugacccagucaaacuaagcagcggcuacaaagaugugauacuuugguuuagcuucggggcaucauguuucauacuucuagccauuguaaugggccuugucuucauauguguaaagaauggaaacaugcggugcacuauuuguauauaa

SEQ ID NO: 40622 - RNA, 1701 nt, Artificial Sequence
  hemagglutinin__InfluenzaA__AGO86686
augaagacuaucauugcuuugagcuacauuuuaugucuggcuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacugauagaugcucuauugggagacccacauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcucugcuugcaaaaggagaucuauuaaaaguuucuuuaguagauugaauugguugcaccaauuagaaaacagauauccagcacugaacgugacuaugccaaacaaugacaaauuugacaaauuguacauuugggggguucaccacccgaguacggacagugaccaaaucagcguauaugcccaagcaucagggagagucacagucucuaccaaaagaagccaacaaacuguaaucccgaauaucggauccagacccuggguaagggguaucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugauggacgguugguacgguuucaggcaucaaaauucugagggcacaggacaagcagcagaucuuaaaagcacucaagcagcaaucaaccaaaucaacgggaaacugaauaaguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagagaaaaugcugaggauaugggcaaugguuguuucaaaacauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucauuaugugggccugccaaaaaggcaacauuaggugcaacauuugcauuuga

SEQ ID NO: 40623 - RNA, 1701 nt, Artificial Sequence; identical to SEQ ID NO: 40578
  hemagglutinin__InfluenzaA__AGQ16240

SEQ ID NO: 40624 - RNA, 1701 nt, Artificial Sequence; identical to SEQ ID NO: 40544
  hemagglutinin__InfluenzaA__AGQ16241

SEQ ID NO: 40625 - RNA, 1701 nt, Artificial Sequence
  hemagglutinin__InfluenzaA__AGQ16242
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagcacauccuacauuaaugauaaagggaaagaaauccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuacgacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40626 - RNA, 1701 nt, Artificial Sequence; identical to SEQ ID NO: 40564
  hemagglutinin__InfluenzaA__AGQ16243

SEQ ID NO: 40627 - RNA, 1701 nt, Artificial Sequence
  hemagglutinin__InfluenzaA__AGQ16245
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaaacauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaauagagccaggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccaugauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40628 - RNA, 1701 nt, Artificial Sequence
  hemagglutinin__InfluenzaA__AGQ16247
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucugguucagacaauggaacguguuacccaggagauuucaucgauuaugaggagcuaagagagcaauugagcucagugucaucauuugaaagguuugagauauuccccaaaacaaguucauggccaaaucaugacucgaacaaagguguaacggcagcauguccucaugcuggagcaaaaggcuucuacaaaaauuuaauauggcuaguuaaaaaaggaaauucauacccaaagcucagcauauccuacauuaaugacaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauuugcaauggaaagaaaugcuggaucugguauuaucauuucagauacaccaguucacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugcuggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugauuacccaaaauacucagaggaagcaaaauuaaacagagaagaaauagaugggguaaagcuggaaucaacaaggauuuaccagauuuuggcgaucuauucaacugccgcuaguucauugguacugguagucucccugggggcaaucaguuuuuggaugugcucuaaugggucucuacaguguagaauauguauuuaa

SEQ ID NO: 40629 - RNA, 1701 nt, Artificial Sequence
  hemagglutinin__InfluenzaA__AGQ16248
augcaggcaauacuaguaguucugcuauauacauuugcaaccgcaacugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaauccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacaucuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuaccccaaauacucagaggaagcaaaauuaaacagagaaaaaauagaugggguaaagcuggaaucaacaaggauuuaccagauuuuggcgaucuauucaacugucgccaguucauugguacugguagucucccugggagcaaucagcuucuggaugugcucuaaugggucucuacaguguagaauauguauuuaa

SEQ ID NO: 40630 - RNA, 1701 nt, Artificial Sequence
  hemagglutinin__InfluenzaA__AGQ16329
augaagacuaucauugcuuugagcuacauucuaugucugguuuucgcucaaaaacuuccuggaaaugacaauagcacggcaacgcugugccuugggcaccaugcaguaccaaacggaacaauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaaggaauauuccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggaggggaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40631 - RNA, 1701 nt, Artificial Sequence
  hemagglutinin__InfluenzaA__AGQ16331
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaaugucaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40632 - RNA, 1701 nt, Artificial Sequence
  hemagglutinin__InfluenzaA__AGQ16332
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucaaaauuccucaauaggugaaauaugcgacaguccucaucagauucuugauggagaaaacugcacacuaauagaugcucuauugggggacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40633 - RNA, 1701 nt, Artificial Sequence
  hemagglutinin__InfluenzaA__AGQ16333
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauauaacgcggagcuucuuguugcccuggagaaccaacauacaauagaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40634 - RNA, 1701 nt, Artificial Sequence
  hemagglutinin__InfluenzaA__AGQ16335
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagguccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaaacacucugaaauuggcaacaggaaugcgaaacguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40635 - RNA, 1701 nt, Artificial Sequence
  hemagglutinin__InfluenzaA__AGQ16336
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaaucguaguuucuuuaguagauuaaauugguugacccacuuaaacuucaaauacccagcauugaacgugacuaugccaaacaacgaacaauuugacaaauuguacauuugggggguucaccacccggguacggacaaggaccaaaucuuccuguaugcgcaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaacguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40636 - RNA, 1701 nt, Artificial Sequence; identical to SEQ ID NO: 40634
  hemagglutinin__InfluenzaA__AGQ16337

SEQ ID NO: 40637 - RNA, 1701 nt, Artificial Sequence
  hemagglutinin__InfluenzaA__AGQ16338
augaagacuaucauugcuuugagcuacauucuaugucugguuuucgcucaaaaacuuccuggaaaugacaauagcacggcaacgcugugccuugggcaccaugcaguaccaaacggaacgauagucaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaucgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40638 - RNA, 1701 nt, Artificial Sequence
  hemagglutinin__InfluenzaA__AGQ16339
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaaaauuggauccuauggauuuccuuugccauaucauguuuuuugcuuuguguugcuuuguugggguucaucaugugggccugccaaaagggcaacauuaggugcaacauuugcauuuga

SEQ ID NO: 40639 - RNA, 1701 nt, Artificial Sequence
  hemagglutinin__InfluenzaA__AGQ16340
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaagucacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggggucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccagaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaagccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaaccagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40640 - RNA, 1701 nt, Artificial Sequence
  hemagglutinin__InfluenzaA__AGQ16341
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40641 - RNA, 1701 nt, Artificial Sequence; identical to SEQ ID NO: 40372
  hemagglutinin__InfluenzaA__AGQ16342

SEQ ID NO: 40642 - RNA, 1701 nt, Artificial Sequence
  hemagglutinin__InfluenzaA__AGQ16343
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucuuccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccucgagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40643 - RNA, 1701 nt, Artificial Sequence
  hemagglutinin__InfluenzaA__AGQ16344
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaauggcuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40644 - RNA, 1701 nt, Artificial Sequence; identical to SEQ ID NO: 40640
  hemagglutinin__InfluenzaA__AGQ16345

SEQ ID NO: 40645 - RNA, 1701 nt, Artificial Sequence
  hemagglutinin__InfluenzaA__AGQ16346
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaggucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40646 - RNA, 1701 nt, Artificial Sequence
  hemagglutinin__InfluenzaA__AGQ16347
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacauuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40647 - RNA, 1701 nt, Artificial Sequence
  hemagglutinin__InfluenzaA__AGQ16348
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugaguugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40648 - RNA, 1701 nt, Artificial Sequence; identical to SEQ ID NO: 40646
  hemagglutinin__InfluenzaA__AGQ16349

SEQ ID NO: 40649 - RNA, 1701 nt, Artificial Sequence
  hemagglutinin__InfluenzaA__AGQ16350
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaagcaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucauguggaccugccaaaagggcaacauuaggugcaacauuugcauuuga

SEQ ID NO: 40650 - RNA, 1701 nt, Artificial Sequence
  hemagglutinin__InfluenzaA__AGQ47719
augaaggcaauacuauuagucuuguuauguacauuuacagccacaaaugcagacacacuauguauagguuaucaugcaaauaauucaacugacacuguugauacagugcuagaaaagaauguaacaguaacacacucuguuaaucuucuugaagacagacauaacgggaaacuauguaaacuaggggggauagccccauugcaccuggguaaauguaacauugccggauggcuuuugggaaacccagaaugugaauuacuauucacaguaagcucauggucuuacauuguggaaacaucgaacucagacaaugggacauguuacccaggagauuucaucaauuaugaagagcugagagagcaguugaguucagugucaucauuugaaagauucgagauauuccccaagacaaguucguggcccgaucaugaaacaaacagaggugugacggcagcaugcccuuaugcuggagcaaacagcuucuacagaaauuuaauauggcuggugaaaaaaggaaauucauacccaaagcucagcaaauccuauguuaacaauaaagggaaggaaguccuugugcuauggggcauucaccauccaccuaccaguacugaucaacaaagucucuaccaaaaugcagaugccuauguuuuuguagggucaucaaaauauaacaggaaguucaagccagaaauagcagcaagacccaaggugagaggucaagcagggaggaugaacuauuacuggacacuaauagaaccuggagacacaauaacauucgaagcaacuggaaauuuagugguaccaagauaugcuuucgcaaugaauagagguucuggaucugguauuauaauuucggaugcaccaauucaugauuguaacacgaagugucaaacacccaagggugccauaaacaccagccucccauuucagaauauacauccagucacaauuggagaauguccaaaauaugucaaaagcacaaaauugagaauggcuacaggacuaaggaauaucccgucuauucaaucuagaggucuguuuggagccauugcugguuuuauugaggggggauggacaggaaugauagauggaugguaugguuaucaccaucagaauggacagggaucaggauaugcagcggaccaaaagagcacacaaaaugccauugacgggaucacuaacaaaguaaauucuguuauugaaaagaugaacacgcaauucacggcaguggguaaagaauucaaccacuuggaaaaaagaauagagaauuuaaacaaaaagguugaugaugguuuucuggauguuuggacauacaaugccgaacuguugguucuauuggaaaaugaaagaacucuggauuuccacgacucgaauguaaagaaccuguaugagaaagugagaagccagcuaaggaacaaugccaaagaaauugggaauggcugcuuugaauucuaucacaaaugugaugauacaugcauggagagcgucaaaaauggaacuuaugauuacccaaaguacucagaagaaucaaaacuaaacagagaggagauagauggaguaaaguuggagucaacaaggauuuaccagauuuuggcgauuuauucaacugccgccaguucauugguacuguuggucucccugggggcaaucaguuucuggaugugcucuaaugggucuuuacagugcagaauauguauuuaa

SEQ ID NO: 40651 - RNA, 1698 nt, Artificial Sequence; identical to SEQ ID NO: 32619
  hemagglutinin__InfluenzaA__AGQ47728

SEQ ID NO: 40652 - RNA, 1701 nt, Artificial Sequence
  hemagglutinin__InfluenzaA__AGQ47740
augaaggcaagacuacugguccuguuaugugcacuugcagcuacagaugcagacacaauauguauaggcuaccaugcgaacaacucaaccgacacuguugacacacuacucgagaagaaugugacagugacacauucuguuaaccugcucgaagacagccacaacgggaaacuauguaaauuaaaaggaauagccccacuacaauuggggaaauguaacaucgccggauggcucuugggaaacccagaaugcgacucacugcuuccagcgagaucaugguccuacauuguagaaacaccaaacucugagaauggagcauguuauccaggagauuucaucgacuaugaggaacugagggagcaauugagcucaguaucaucauuagaaagauucgaaauauuucccaaggaaaguucauggcccaaccacaacacaaucaaaggaguaacagcaucaugcucccauaggggacaaagcaguuuuuacagaaauuugcuauggcugacgaagaagggggacucauacccaaagcugaacaauuccuaugugaacaauaaagggaaagaaguccuuguacuaugggguguucaucacccgucuagcaguaaugagcaacagagucucuaucguaaugaaaaugcuuaugucucuguagugucuucaaauuauaacaggagauucaccccggaaauagcugcaagacccaaaguaagagaucaaacugggaggaugaacuauuacuggaccuugcuagaacccggagacacaauaauguuugaggcaacugguaaucuaauagcaccaugguaugcuuucgcacugaguagaggguuuggguccggcaucaucaccucaaacgcgucaaugcaugaguguaacacgaagugucaaacaccccagggagcuauaaacagcagucucccuuuccagaauauacacccagucacaauaggagagugcccaaaauaugucaggaguaccaaauugaggaugguuacaggacuaagaaacaucccauccauucaauccagaggucuauuuggagccauugcugguuuuauugaggggggauggacuggaaugauagauggaugguaugguuaucaucaucagaaugaacagggaucaggcuaugcagcggaucaaaaaagcacacaaaaugccauuaacgggauuacaaacaaggugaacucuguuaucgagaaaaugaacacucaauucacagcuguggguaaagaauucaacaacuuagaaaaaaggauggaaaauuuaaauaaaaaaguugaugauggauuucuggacauuuggacauauaaugcagaauuguuaguucuacuggaaaaugaaaggacuuuggauuuccaugacuuaaaugugaagaaucuguacgagaaaguaaaaagccaauuaaagaauaaugccaaagaaaucggaaauggguguuuugaguucuaccacaagugugacaaugaaugcauggaaaguguaagaaaugggacuuaugauuauccaaaauauucagaagaaucaaaguugaacagggaaaagauagauggagugaaauuggaaucaauggggguguaucagauucuggcgaucuacucaacugucgccaguucacuggugcuuuuggucucccugggggcaaucaguuucuggauguguucuaaugggucuuugcagugcagaauaugcaucuga

SEQ ID NO: 40653 - RNA, 1701 nt, Artificial Sequence
  hemagglutinin__InfluenzaA__AGQ47752
augaaagcaaaacuacugauccuguugugugcacuuucagcuacagaugcagacacaauauguauaggcuaccaugcgaacaacucaaccgacacuguugacacaguacucgaaaagaaugugacagugacacacucuguaaaccuacucgaagacagccacaaugggaaauuaugcagauuaaaaggaaaagccccacuacaauuggggaaauguaacauugccggaugggucuuaggaaacccagaaugcgaaucauugcuuuccaauagaucaugguccuacauugcagaaacaccaaacucugagaaugggauauguuacccaggagauuucgccgacuaugaggaacugagggagcaauugagcucaguaucaucauucgagagauucgaaauauuccccaaggaaagaucauggcccaaacacaacacaaucagaggagugacggcagcaugcucccaugcggggaaaagcaguuuuuacaaaaauuuggucuggcugacggaggcaaauggcucauacccagcucugagcacguccuaugugaacaaucaagagaaagaaguccuugugcuaugggguguucaucacccgucuaacauagaggaacaaaggacccucuaucggaaagauaaugcuuaugucucuguagugucuucaaauuauaacaggagauucaccccagaaauagcaaaaaggcccaaaguaagagaucaaccagggagaaugaacuauuacuggacuuugcuagaacccggagacacaauaauauuugaggcaacuggaaaucuaauagcaccaugguaugcuuucgcacugaguagaggcccuggaucaggaaucaucaccucaaacgcaccaauggaugaaugugacacgaagugucaaacaccccagggagcuauaaacaguagucucccuuuucagaauauacacccagucacaauaggagagugcccaaaauacgucaggaguacaaaauugaggaugguuacaggacuaaggaacaucccauccauucaauccaggggucuguuuggagccauugccgguuucauugaagggggauggacugggaugauggauggaugguaugguuaccaucaucagaaugaacagggaucuggcuaugcugcggaucaaaaaagcacacaaaaugccauuaacgggauuacaaauaaggugaacucuguuaucgagaaaaugaacacucaauucacagcuguggguaaagaauucaacaaauuagaaaaaagaauggaaaacuuaaauaaaaaaguugaugauggauuucuggauauuuggacauauaaugcagaauuguugguucuacuggaaaaugaaaggacuuuggauuuucaugacucaaaugugaagaaucuguaugagaaaguaaaaaaccaauuaaggaauaaugcaaaggaacuaggaaacggguguuuugaguucuaccacaagugugacaaugaaugcauggaaaguguaaaaaauggaacuuaugauuacccaaaauauucagaggaaucaaaguuaaacagggaaaagauugauggagugaaauuggaaucaaugggggucuaucggauucuggcgaucuacucaacugucgccaguucacuggugcuucuggucucccugggggcaaucagcuucuggauguguucuaaugggucuuuacagugcagaauaugcaucuga

SEQ ID NO: 40654 - RNA, 1701 nt, Artificial Sequence
  hemagglutinin__InfluenzaA__AGQ47764
augaaagcaaaacuacugauccuguuaugugcacuuacagcuacagaugcagacacaauauguauaggcuaccaugcgaacaacucaaccgacacuguugacacaguacucgaaaagaaugugacagugacacacucuguaaaccuacucgaagacagccacaacgggaaauuaugcagauuaaaaggaauagccccacuacaauuggggaaauguaacauugccggauggaucuuaggaaacccagaaugcgaaucacugcuuucuaagagaucaugguccuacauugcagaaacaccaaacucugagaauggagcauguuacccaggagauuucgccgacuaugaggaacugagggagcaauugagcucagugucaucauucgagagauucgaaauauuccccaaggaaagaucauggcccaaacacaacauaaccagaggaguaacggcagcaugcucccaugcggggaaaagcaguuuuuacaaaaauuugcucuggcugacggagacagauggcucauacccaaagcugagcaaguccuaugugaacaauaaagagaaagaaguccuugugcuaugggguguucaucacccgucuaacauagaggaucaaaagacccucuaucggaaagaaaaugcuuaugucucuguagugucuucaaauuauaacaggagauucaccccggaaauagcagaaagacccaaaguaagaggucaagcagggagaauuaacuauuacuggacuuugcuagaacccggagacacaauaauauuugaggcaaauggaaaucuaauagcgccaugguaugcuuucgcacugaguagagacuuuggaucaggaaucaucaccucaaacgcaucaauggaugaaugugacacgaagugucaaacaccccagggagcuauaaacaguagucucccuuuucagaauauacacccagucacaauaggagagugcccaaaauacgucaagaguaccaaauugaggaugguuacaggauuaaggaacaucccauccauucaauccagaggucuguuuggagccauugccgguuucauugaggggggauggacuggaaugauagauggaugguaugguuaccaucaucagaaugaacagggaucuggcuaugcugcggaucaaaaaagcacacaaaaugcaauuaacgggauuacaaauaaggugaacucuguuaucgagaaaaugaacacucaauucacagcuguggguaaagaauucaacaaauuagaaaaaagaauggaaaacuuaaauaaaaaaguugaugauggguuucuggacauuuggacauauaaugcagaauuguugguucuacuggaaaaugaaaggacuuuggauuuccaugacucaaaugugaagaaucuguaugagaaaguaaaaaaccaauuaaggaauaaugcaaaggaaauaggaaacggguguuuugaguucuaccacaaguguaacaaugaaugcauggaaaguguaaaaaauggaacuuaugauuacccaaaauauucagaggaaucaaaguuaaacagggaaaaaauugauggagugaaauuggaaucaaugggggucuaucagauucuggcgaucuacucaacugucgccaguucacuggugcuucuggucucccugggggcaaucagcuucuggauguguucuaaugggucuuugcaaugcagaauaugcaucuga

SEQ ID NO: 40655 - RNA, 1701 nt, Artificial Sequence
  hemagglutinin__InfluenzaA__AGQ47776
augaaagcaaaacuacugauccuguuaugugcacuuucagccacagaugcagacacaauauguauaggcuaccaugcgaacaacucaaccgacacuguugacacaguacucgaaaagaaugugacagugacacacucuguaaaccuacucgaagacagccacaacgggaaauuaugcagauuaaaaggaauagccccacuacaauuggggaaauguaacauugccggauggaucuuaggaaacccagaaugcgaaucacugcuuucuaagagaucaugguccuacauugcagaaacaccaaacucugagaauggaacauguuacccaggagauuucgccgacuaugaggaacugagggagcaauugagcucaguaucaucauucgagagauucgaaauauuccccaaggaaagaucauggcccaaacacaacauaaacauaggaguaacggcagcaugcucccaugcggggaaaagcaguuuuuacaaaaauuugcucuggcugacggagaaagauggcucauacccaaaucugaacaaguccuaugugaacaagaaagagaaagaaguccuuguacuaugggguguucaucacccgucuaacauagaggaucaaaagacccucuaucggaaagaaaaugcuuaugucucuguagugucuucaaauuauaacaggagauucaccccggaaauagcagaaagacccaaaguaagaggucaagcagggagaaugaacuauuacuggacuuugcuagaacccggagacacaauaauauuugaggcaaauggaaaucuaauagcgccaugguaugcuuucgcacuaaguagaggccuuggaucaggaaucaucaccucaaacgcaucaauggaugaaugugacacgaagugucaaacaccccagggagcuauaaacaguagucucccuuuccagaauauacacccauucacaauaggagagugcccaaaauacgucaggaguaccaaauugaggaugguuacaggacuaaggaacaucccauccauucaauccagaggucuguuuggagccauugccgguuucauugaagggggauggacuggaaugauagauggaugguaugguuaccaucaucagaaugaacagggaucuggcuaugcugcggaucaaaaaagcacacaaaaugccauuaacgggauuacaaauaagguaaacucuguuaucgagaaaaugaacacucaauucacugcuguggguaaagaauucaacaaauuagaaaaaagaauggaaaacuuaaauaaaaaaguugaugauggauuucuggacauuuggacauauaaugcagaauuguugguucuacuggaaaacgaaaggacuuuggauuuccaugacucaaaugugaagaaucuguaugagaaaguaaaaaaccaauuaaggaauaaugccaaagaaauaggaaacggguguuuugaguucuaccacaaguguaacaaugaaugcauggaaaguguaaaaaauggaacuuaugauuacccaaaauauucagaggaaucaaaguuaaacagggaaaaaauugauggagugaaauuggaaucaaugggggucuaucagauucuggcgaucuacucaacugucgccaguucacuggugcuucuggucucccugggggcaaucagcuucuggauguguucuaaugggucuuugcagugcagaauaugcaucuga

SEQ ID NO: 40656 - RNA, 1701 nt, Artificial Sequence
  hemagglutinin__InfluenzaA__AGQ47788
augaaagcaaaacuacugguccuguuaugugcacuuucagcuacagaugcagacacaauauguauaggcuaccaugcgaacaacucaaccgacacuguugacacaguacucgaaaagaacgugacagugacacacucugucaaccuacucgaggacagucacaacggaaaacuaugcagacuaaaaggaauagccccacuacaauuggggaaaugcaacauugccggauggaucuuaggaaacccagaaugcgaaucacuguuuucuaagaaaucaugguccuacauugcagaaacaccaaacucugagaauggaacauguuacccaggauauuucgccgacuaugaggaacugagggagcaauugagcucaguaucaucauucgagagauucgaaauauuccccaaggaaaggucauggcccaaacacaacguaaccagaggaguaacggcagcaugcucccauaaggggaaaagcaguuuuuacagaaauuugcuauggcugacggagaaagauggcucguacccaaaucugagcaaguccuaugugaacaauaaagagaaagaaguccuuguacuaugggguguucaucacccgucuaacauagaggaccaaaagacccucuaucggaaagaaaaugcuuaugucucuguagugucuucaaauuauaacaggagauucaccccagaaauagcagaaagacccaaaguaagaggucaagcagggagaauuaacuacuacuggacucugcuggaacccggggacacaauaauauuugaggcaaauggaaaucuaauagcgccauggcaugcuuucgcacugaguagaggcuuugggucaggaaucaucaccucaaacgcaucgauggaugaaugugacacgaagugucaaacaccccagggagcuauaaacaguagucucccuuuccagaauauacacccagucacaauaggagagugcccaaaauacgucaggaguacaaaauugaggaugguuacaggacuaaggaacaucccauccauucaauccagaggucuguuuggggccauugccgguuucauugaagggggauggacuggaaugauagauggaugguaugguuaucaucaucagaaugaacagggaucuggcuaugcugcggaucaaaaaagcacacaaaaugccauuaacgggauuacaaacaaggugaacucuguuaucgagaaaaugaacacucaauucacagcuguggguaaagaauucaacaaauuagaaaaaaggauggaaaacuuaaauaaaaaaguugaugauggauuucuggacauuuggacauauaaugcagaauuguugguucuacuggaaaaugaaaggacuuuggauuuucaugacucaaaugugaagaaucuguaugagaaaguaaaaagccaauuaaagaauaaugccaaagaaauaggaaacggguguuuugaauucuaccacaaguguaacaaugaaugcauggaaaguguaaaaaauggaacuuaugauuauccaaaauauucagaggaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 40657 - RNA, 1701 nt, Artificial Sequence
  hemagglutinin__InfluenzaA__AGQ47800
augaaggcaagacuacugguccuguuaugugcacuugcagcuacagaugcagacacaauauguauaggcuaucaugcgaacaacucaaccgauacuguugacacaauacucgaaaagaaugugacagugacacacucugucaaccuacucgaagacagccacaacgggaaauuauguagauuaaaaggaauagccccacuacaauuggggaaauguaacauugcuggauggauccugggaaacccagaaugcgaaucacugcuuucagagagaucaugguccuacauuguugaaauaccaaacucugagaauggaacauguuacccaggagauuuuaccgacuaugaggaacugagggagcaauugagcucuguaucaucauucgaaagauucgaaauauuccccaaggaaagcucauggcccaaacacaacacagccagaggaguaacggcagcaugcucccaugcgggaaaaagcaguuuuuacagaaauuugcuauggcugacggagaaggauggcucauauccgaaucugaaaaauuccuaugugaacaagaaagggaaagaaguccuuguacuaugggguguucaucacccguccagcauaaaggaacaacagacccucuaucagaaagaaaaugcuuaugucucuguaguaucuucaaauuacaacaggagauucaccccggaaauagcagaaagacccaaaguaagagaucaagcagggaggaugaacuauuacuggaccuugcuagaacccggagacacaauaauauuugaggcaaauggaaaucuaauagcgccaugguaugcuuucgcacugaguagaggcuuugggucaggcaucaucaccucaaacgcaucgaugcaugagugugacacgaagugucaaacaccccagggagcuauaaacagcagucucccuuuccagaauauacacccagucacaauaggagagugcccaaaauacgucaggaguaccaaauugaggaugguuacaggacuacggaacaucccaucaauucaauccagaggucuauuuggagccauugccgguuucauugaagggggauggacuggaaugauagauggaugguaugguuaucaucaucagaaugaacagggaucaggcuaugcugcggaucaaaaaagcacacaaaaugccauuaacgggauuacaaacaaggugaacucuguuaucgagaagaugaacacucaauucacagcuguggguaaagaauucaacaacuuagaaaaaaggauggaaaacuuaaacaaaaaaguugaugauggauuucuggacauuuggacauauaaugcagaauuguugauucuacuggaaaaugaaaggacucuggauuuccaugacucaaaugugaagaaucuguaugaaaaaguuaaaagccaauuaaggaauaaugccaaagaaauaggaaacggguguuuugaguucuaccacaaguguaacaaugaaugcauggaaaguguaaaaaauggaacuuaugauuauccaaaauauucagaagaaucaaaguugaacagggaaaaaauagauggagugaaauuggaaucaaugggggucuaucagauucuggcgaucuacucaacugucgccaguucacuggugcuucuagucucccugggggcaaucagcuucuggauguguucuaaugggucuuugcagugcagaauaugcaucuga

SEQ ID NO: 40658 - RNA, 1701 nt, Artificial Sequence
  hemagglutinin__InfluenzaA__AGQ47811
augaaagcaaaacuacugguccuguuaugugcacuuucagcuacagaugcagacacaauauguauaggcuaccaugcgaacaacucaaccgacacuguugacacaguacucgaaaagaacgugacagugacacacucugucaaccuacucgaggacagucacaacggaaaacuaugcagacuaaaaggaauagccccacuacaauuggggaaaugcaacauugccggauggaucuuaggaaacccagaaugcgaaucacuguuuucuaagaaaucaugguccuacauugcagaaacaccaaacucugagaauggaacauguuacccaggauuuuucgccgauuaugaggaacugagggagcaauugagcucaguaucaucauucgagagauucgaaauauuccccaaggaaaggucauggcccaaacacaacguaaccagaggaguaacggcagcaugcucccauaaggggaaaagcaguuuuuacagaaauuugcuauggcugacggagaaaaauggcucguacccaaaucugagcaaguccuaugugaacaacaaagagaaagaaguccuuguacuaugggguguucaucacccgucuaacauagaggaccaaaagaccaucuaucggaaagaaaaugcuuaugucucuguagugucuucaaauuauaacaggagauucaccccagaaauagcagaaagacccaaaguaagaggucaagcagggagaauuaacuacuacuggacucugcuggaaccuggggacacaauaauauuugaggcaaauggaaaucuaauagcgccauggcaugcuuucgcacugaguagaggcuuugggucagggaucaucaccucaaacgcaucgauggaugaaugugacacgaagugucaaacaccccagggagcuauaaacaguagucucccuuuccagaauauacacccagucacaauaggagagugcccaaaauacgucaggaguacaaaauugaggaugguuacaggacuaaggaacaucccauccauucaauccagaggucuguuuggggccauugccgguuucauugaagggggauggacuggaaugauagauggaugguaugguuaucaucaucagaaugaacagggaucuggcuaugcugcggaucaaaaaagcacacaaaaugccauugacgggauuacaaacaaggugaacucugucaucgagaaaaugaacacucaauucacagcuguggguaaagaauucaacaaauuagaaaaaaggauggaaaacuuaaauaaaaaaguugaugauggauuucuggacauuuggacauauaaugcagaauuguugguucuacuggaaaaugaaaggacuuuggauuuucaugacucaaaugugaagaaucuguaugagaaaguaaaaagccaauuaaagaauaaugccaaagaaauaggaaacggguguuuugaauucuaccacaaguguaacaaugaaugcauggaaaguguaaaaaauggaacuuaugacuauccaaaauauucagaggaaucaaaguuaaacagggaaaaaauugauggaguaaaguuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 40659 - RNA, 1701 nt, Artificial Sequence
  hemagglutinin__InfluenzaA__AGQ47823
augaaagcaaaacuacuaguccuguuaugugcauuuacagcuacauaugcagacacaauauguauaggcuaccaugcgaacaacucaaccgacacuguugacacaguacuugagaagaacgugacagugacacacucugucaaccuacuugaggacagucacaacggaaaacuaugucgacuaaagggaauagccccacuacaauuggguaauugcagcguugccggauggaucuuaggaaacccaaaaugcgaaucacuguuuucuaaggaaucaugguccuacauugcagaaacaccaaacccugagaauggaacauguuacccaggguauuucgccgacuaugaggaacugagggagcaauugaguucaguaucaucauucgagagauucgaaauauuccccaaagaaagcucauggcccaaccacaccguaaccaaaggaguaacgacaucaugcucccauaaugggaaaagcaguuuuuacagaaauuugcuauggcugacggagaagaauggcuuguacccaaaucugagcaaguccuauguaaacaacaaagagaaagaaguccuuguacuaugggguguucaucacccgucuaacauaagggaccaaagggccaucuaucauacagaaaaugcuuaugucucuguagugucuucacauuauagcagaagauucaccccagaaauagcaaaaagacccaaaguaagaggucaagaaggaagaauuaacuacuacuggacucugcuggaacccggggacacaauaauauuugaggcaaauggaaaucuaauagcgccaugguaugcuuucgcacugaguagaggcuuugggucaggaaucaucaccucaaacgcaucaauggaugaaugugacgcgaagugucaaacaccccagggagcuauaaacaguagucuuccuuuccagaauguacacccagucacaauaggagaguguccaaaguaugucaggaguacaaaauuaaggaugguuacaggacuaaggaacaucccauccauucaauccagagguuuguuuggagccauugccgguuucauugaagggggguggacuggaaugauagauggaugguaugguuaucaucaucagaaugaacaaggaucuggcuaugcugcggaccaaaaaagcacacaaaaugccauuaacgggauuacaaacaaggugaauucuguaaucgagaaaaugaacacucaauucacagcugugggcaaagaauucaacaaauuagaaagaaggauggaaaacuuaaauaaaaaaguugaugauggauuucuggacauuuggacauauaaugcagaauuguugguucuacuggaaaauggaaggacuuuggauuuucaugacucaaaugugaagaaucuguaugagaaaguaaaaagccaauugaagaauaaugccaaagaaauagggaacggguguuuugaauucuaucacaaguguaacaaugaaugcauggaaagugugaaaaauggaacuuaugacuauccaaaauauuccgaagaaucaaaguuaaacaggggaaaaauugauggagugaaauuggaaucaaugggagucuaucagauucuggcgaucuacucaacugucgccaguucacuggugcuuuuggucucccugggggcaaucagcuucuggauguguucuaaugggucuuugcaguguagaauaugcaucuga

SEQ ID NO: 40660 - RNA, 1701 nt, Artificial Sequence
  hemagglutinin__InfluenzaA__AGQ47835
augaagacuaucauugcuuugagcuacauuuucugucugguucucggccaagacuuuccaggaaaugacaacagcacagcaacgcugugccugggacaucaugcggugccaaacggaacaauagugaaaacaaucacaaaugaucagauugaagugacuaaugcuacugagcugguucagaguuccucaacggggaaaauaugcaacaauccucaucgaauccuugauggaauaaacugcacacugauagaugcucuauugggggacccucauugugauggcuuucaaaaugagacaugggaccuuuucguugaacgcagcaaagcuuucagcaacuguuacccuuauuaugugccagauuaugccucccuuaggucacuaguugccucgucaggcacucuggaguuuaucaaugaaggcuucaauuggacuggggucacucagaaugggggaagcaaugcuugcaaaaggggaccuaauagcgguuuuuucaguagacugaacugguuguacaaaucaggaaccacauauccagugcugaacgugacuaugccaaacaaugacaauuuugacaaacuauacauuugggggguucaccacccgagcacggaccaagaacaaaccaaccuauauguucaagcaucagggagagucacagucuccaccaagagaagccagcaaacuauaaccccgaauaucgggucuagacccuggguaaggggucugucuaguagaauaagcaucuauuggacaauaguuaaaccgggagacauccugguaauuaauaguaaugggaaccuaauugcuccucgggguuauuucaaaaugcgcacugggaaaagcucaauaaugaggucagaugcaccuauuggcaccugcauuucugaaugcaucacuccaaauggaagcauucccaaugacaagcccuuucaaaacguaaacaagaucacauauggggcaugucccaaguauguuaagcaaaacacccugaaguuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagccaucgaccaaaucaaugggaaacugaauaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaaugggacuuaugaccaugauguauacagagacgaagcauugaacaaccgguuucagaucaaagguguugaacugaagucaggauacaaagacuggauccuguggauuuccuuugccauaucaugcuuuuugcuuuguguuguuuugcugggguucaucaugugggccugccagaaaggcaacauuaggugcaacauuugcauuuga

SEQ ID NO: 40661 - RNA, 1701 nt, Artificial Sequence
  hemagglutinin__InfluenzaA__AGQ47847
augaaggcaagacuacugauccuguugugugcacuugcagcuacagaugcagacacaauauguauaggcuaccaugcgaacaauucaaccgacacuguugacacaguacucgagaagaaugugacagugacacacucuguuaaccugcucgaagacagccacaacgggaaacuauguagauuaaaaggaauagccccacuacaauuggggaaauguaacaucgccggauggcucuugggaaacccagaaugcgacucauugcuuccagcgaguucaugguccuacauuguagaaacaccaaacucuaagaauggaauauguuauccaggagauuucaucgacuaugaggaacugagggagcaauugagcucaguaucaucauucgaaagauucgaaauauuucccaaggaaagcucauggcccaaacacaacacaaccaaaggagugacggcagcaugcucccaugcgggaaagagcaguuuuuacagaaauuugcuauggcugacgaagaaggaggacucauacccaaagcugagcaauuccuaugugaacaagaaagggaaagaaguccuuguacuaugggguguucaucacccgucuaacaguaaagagcaacagacucucuaucagaaugaaaaugcuuaugucucuguagugucuucaaauuauaacaggagauucaccccggaaauagcagaaagacccaaaguaagagaucaagcugggaggaugaacuauuacuggaccuugcuagaacccggagacacaauaauauuugaggcuaauggaaaucuaauagcaccaugguaugcuuucgcacugaguagaggcuuuggguccggcaucaucaccucaaacgcaucaaugcaugaguguaacacgaagugucaaacaccccagggagcuauaaacagcagucucccuuuccagaauauacacccagucacaauaggagagugcccaaaauacgucaagagugccaaauugaggaugguuacaggacuaagaaacaucccauccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacucuguuaucgagaaaaugaacacucaauucacugcuguggguaaagaauucaacaacuuagaaaaaaggauggaaaauuuaaauaaaaaaguugaugauggauuccuggacauuuggacguauaaugcagaauuguuaguucuacuggaaaaugaaagaacucuggauuuccaugacucaaaugugaaaaaucuguaugagaaaguaaaaauccaauuaaagaauaaugccaaagaaaucggaaauggguguuuugaguucuaccacaagugugacaaugaaugcauggaaagugugagaaaugggacuuaugauuauccaaaauauucaaaagaaucaaaguugaacagggaaaagauagauggagugaaauuggaaccaaugggggucuaucagauucuggcgauauacucaacugucgccaguucacuggugcuuuuggucucccugggggcaaucaguuucuggauguguucuaaugggucuuugcagugcagaauaugcaucuga

SEQ ID NO: 40662 - RNA, 1701 nt, Artificial Sequence
  hemagglutinin__InfluenzaA__AGQ47870
augaaggcaauacuauuagucuuguuauguacauuugcagccacaaaugcagacacacuauguauagguuaucaugcaaauaauucaacugacacuguugauacaguacuagaaaagaauguaacaguaacacacucuguuaaucuucuugaagacagacauaacgggaaacuauguaaacugggggggauagccccauugcacuuggguaaauguaacauugccggauggcuuuugggaaacccagaaugugaauuacuacucacaguaagcucauggucuuacauuguggaaacaucgaacucagacaaugggacauguuacccaggagauuucaucaauuaugaagagcugagagagcaguugagcucagugucaucauuugaaagauucgagauauuccccaagacaaguucguggcccaaucaugaaacaaacagaggugugacggcagcaugcccuuaugcuggagcaaacagcuucuacagaaauuuaauauggcuggugaaaaaaggaaauucauacccaaagcucagcaaauccuauguuaacaauaaagggaaggaaguccuugugcuauggggcauucaucauccaccuaccaguacugaucaacaaagucucuaccaaaaugcagaugccuauguuuuuguagggucaucaaaauauaacagaaaguucaagccagaaauagcagcaagacccaaggugagaggucaagcagggaggaugaacuauuacuggacacuaauagaaccuggagacacaauaacauuugaagcaacuggaaaucuagugguaccaagauaugcuuucgcaaugaauagagguucuggaucugguauuauaauuucggaugcaccaguucaugauuguaacacgaagugucaaacacccaagggugccauaaacaccagccucccauuucagaauauacauccagucacaauuggagaauguccaaaauaugucaaaagcacaaaauugagaauggcuacaggacuaaggaauaucccgucuauucaaucuagaggucuguuuggagccauugcugguuuuauugaggggggauggacaggaaugauagauggaugguaugguuaucaccaucagaaugaacagggaucaggauaugcagcggaccaaaggagcacacaaaaugccauugacgggaucacuaacaaaguaaauucuguuauugaaaagaugaacacgcaauucacggcaguggguaaagaauucaaccacuuggaaaaaagaauagagaauuuaaacaaaaagguugaugaugguuuucuggauauuuggacauacaaugcagaacuguugguucuauuggaaaaugaaagaacucuggauuuccacgacucgaauguaaagaaccuguaugagaaaguaagaagccagcuaaggaacaaugccaaagaaauugggaauggcugcuuugaauucuaucacaaaugugaugauacaugcauggagagcgucaaaaaugggacuuaugauuacccaaaguacucagaagaaucaaagcuaaacagagaggagauagauggaguaaaguuggagucaacaagaauuuaccagauuuuggcgaucuauucaacugucgccaguucauugguacuguuggucucccugggggcaaucaguuuuuggaugugcucuaaugggucuuuacagugcagaauauguauuuaa

SEQ ID NO: 40663 - RNA, 1701 nt, Artificial Sequence
  hemagglutinin__InfluenzaA__AGQ47882
augaaggcaauacuauuagucuuguuauguacauuugcagccacaaaugcagacacacuauguauagguuaucaugcaaauaauucaacugacacuguugauacaguacuagaaaagaauguaacaguaacacacucuguuaaucuucuugaagacagacauaacgggaaacuauguaaacugggggggauagccccauugcacuuggguaaauguaacauugccggauggcuuuugggaaacccagaaugugaauuacuacucacaguaagcucauggucuuacauuguggaaacaucgaacucagacaaugggacauguuacccaggagauuucaucaauuaugaagagcugagagagcaguugagcucagugucaucauuugaaagauucgagauauuccccaagacaaguucguggcccaaucaugaaacaaacagaggugugacggcagcaugcccuuaugcuggagcaaacagcuucuacagaaauuuaauauggcuggugaaaaaagaaaauucauacccaaagcucagcaaauccuauguuaacaauaaagggaaggaaguccuugugcuauggggcauucaucauccaccuaccaguacugaucaacaaagucucuaccaaaaugcagaugccuauguuuuuguagggucaucaaaauauaacagaaaguucaagccagaaauagcagcaagacccaaggugagaggucaagcagggaggaugaacuauuacuggacacuaauagaaccuggagacacaauaacauuugaagcaacuggaaaucuagugguaccaagauaugcuuucgcaaugaauagagguucuggaucugguauuauaauuucggaugcaccaguucaugauuguaacacgaagugucaaacacccaagggugccauaaacaccagccucccauuucagaauauacauccagucacaauuggagaauguccaaaauaugucaaaagcacaaaauugagaauggcuacaggacuaaggaauaucccgucuauucaaucuagaggucuguuuggagccauugcugguuuuauugaggggggauggacaggaaugauagauggaugguaugguuaucaccaucagaaugaacagggaucaggauaugcagcggaccaaaggagcacacaaaaugccauugacgggaucacuaacaaaguaaauucuguuauugaaaagaugaacacgcaauucacggcaguggguaaagaauucaaccacuuggaaaaaagaauagagaauuuaaacaaaaagguugaugaugguuuucuggauauuuggacauacaaugcagaacuguugguucuauuggaaaaugaaagaacucuggauuuccacgacucgaauguaaagaaccuguaugagaaaguaagaagccagcuaaggaacaaugccaaagaaauugggaauggcugcuuugaauucuaucacaaaugugaugauacaugcauggagagcgucaaaaaugggacuuaugauuacccaaaguacucagaagaaucaaagcuaaacagagaggagauagauggaguaaaguuggagucaacaagaauuuaccagauuuuggcgaucuauucaacugucgccaguucauugguacuguuggucucccugggggcaaucaguuuuuggaugugcucuaaugggucuuuacagugcagaauauguauuuaa

SEQ ID NO: 40664 - RNA, 1701 nt, Artificial Sequence; identical to SEQ ID NO: 39599
  hemagglutinin__InfluenzaA__AGQ47894

SEQ ID NO: 40665 - RNA, 1701 nt, Artificial Sequence
  hemagglutinin__InfluenzaA__AGQ47906
augaagaccaucauugcuuugagcuacauuuucugucuggcucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggauucaccacccgagcacgaaccaagaacaaaccagccuguauguucaagcaucagggagagucacagucucuaccaggagaagccagcaaacuauaaucccgaauaucggguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 40666 - RNA, 1701 nt, Artificial Sequence
  hemagglutinin__InfluenzaA__AGQ47918
augaagaccaucauugcuuugagcuacauuuucugucuggcucucggccaagaccuuccaggaaaugacaacaacacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccaggagaagccagcaaacuauaaucccgaauaucggguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 40667 - RNA, 1701 nt, Artificial Sequence
  hemagglutinin__InfluenzaA__AGQ47930
augaaggcaaaccuacugguccuguuaugugcacuugcagcugcagaugcagacacaauauguauaggcuaccaugcgaacaauucaaccgacacuguugacacagcacucgagaagaaugugacagugacacacucuguuaaccugcucgaagacagccacaacggaaaacuauguagauuaaaaggaauagccccacuacaauuggggaaauguaacaucgccggauggcucuugggaaacccagaaugcgacccacugcuuccagugagaucaugguccuacauuguagaaacaccaaacucugagaauggaauauguuauccaggagauuucaucgacuaugaggagcugagggagcaauugagcucagugucaucauucgaaagauucgaaauauuucccaaagaaagcucauggcccaaccacaacacaaacaaaggaguaacggcagcaugcucccaugcggggaaaagcaguuuuuacagaaauuugcuauggcugacggagaaggagggcucauacccaaagcugaaaaauucuuaugugaacaagaaagggaaagaaguccuuguacugugggguauucaucacccgucuaacaguaaggaucaacagaaucucuaucagaaugaaaaugcuuaugucucuguagugacuucaaauuauaacaggagauuuaccccggaaauagcagaaagacccaaaguaagagaucaagcugggaggaugaacuauuacuggaccuugcuaaaacccggagacacaauaauauuugaggcaaauggaaaucuaauagcaccaauguaugcuuucgcacugaguagaggcuuuggguccggcaucaucaccucaaacgcaucaaugcaugaguguaacacgaagugucaaacaccccugggagcuauaaacagcagucucccuuuccagaauauacacccagucacaauaggagagugcccaaaauacgucaggagugccaaauugaggaugguuacaggacuaaggaacauuccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacucuguuaucgagaaaaugaacauucaauucacagcuguggguaaagaauucaacaaauuagaaaaaaggauggaaaauuuaaauaaaaaaguugaugauggauuucuggacauuuggacauauaaugcugaauuguuaguucuacuggaaaaugaaaggacucuggauuuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucuga

SEQ ID NO: 40668 - RNA, 1698 nt, Artificial Sequence; identical to SEQ ID NO: 33782
  hemagglutinin__InfluenzaA__AGQ47942

SEQ ID NO: 40669 - RNA, 1698 nt, Artificial Sequence
  hemagglutinin__InfluenzaA__AGQ47954
augaaggcaaaccuacugguccuguuaugugcacuugcagcugcagaugcagacacaauauguauaggcuaccaugcgaacaauucaaccgacacuguugacacaguacucgagaagaaugugacagugacacacucuguuaaccugcucgaagacagccacaacggaaaacuauguagauuaaaaggaauagccccacuacaauuggggaaauguaacaucgccggauggcucuugggaaacccagaaugcgacccacugcuuccagugagaucaugguccuacauuguagaaacaccaaacucugagaauggaauauguuauccaggagauuucaucgacuaugaggagcugagggagcaauugagcucagugucaucauucgaaagauucgaaauauuucccaaagaaagcucauggcccaaccacaacacaaacggaguaacggcagcaugcucccaugaggggaaaagcaguuuuuacagaaauuugcuauggcugacggagaaggagggcucauacccaaagcugaaaaauucuuaugugaacaaaaaagggaaagaaguccuuguacugugggguauucaucacccgccuaacaguaaggaacaacagaaucucuaucggaaugaaaaugcuuaugucucuguagugacuucaaauuauaacaggagauuuaccccggaaauagcagaaagacccaaaguaagagaucaagcugggaggaugaacuauuacuggaccuugcuaaaacccggagacacaauaauauuugaggcaaauggaaaucuaauagcaccaauguaugcuuucgcacugaguagaggcuuuggguccggcaucaucaccucaaacgcaucaaugcaugaguguaacacgaagugucaaacaccccugggagcuauaaacagcagucucccuuaccagaauauacacccagucacaauaggagagugcccaaaauacgucaggagugccaaauugaggaugguuacaggacuaaggaacauuccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacacuguuaucgagaaaaugaacauucaauucacagcuguggguaaagaauucaacaaauuagaaaaaaggauggaaaauuuaaauaaaaaaguugaugauggauuucuggacauuuggacauauaaugcagaauuguuaguucuacuggaaaaugaaaggacucuggauuuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucuga

SEQ ID NO: 40670 - RNA, 1698 nt, Artificial Sequence
  hemagglutinin__InfluenzaA__AGQ47966
augaaggcaaaccuacugguccuguuaugugcacuugcagcugcagaugcagacacaauauguauaggcuaccaugcgaacaacucaaccgacacuguugacacaguacucgagaagaaugugacagugacacacucuguuaaccugcucgaagacagccacaacggaaaacuauguagauuaaaaggaauagccccacuacaauuggggaaauguaacaucgccggauggcucuugggaaacccagaaugcgacccacugcuuccagugggaucaugguccuacauuguagaaacaccaaacucugagaauggaauauguuauccaggagauuucaucgacuaugaggagcugagggagcaauugagcucagugucaucauucgaaagauucgaaauauuucccaaagaaagcucauggcccgaccacaacacaaacggaguaacggcagcaugcucccaugaggggaaaaacaguuuuuacagaaauuugcuauggcugacggagaaggagagcucauacccaaagcugaaaaauucuuaugugaacaaaaaagggaaagaaguccuuguacugugggguauucaucacccgccuaacaguaaggaacaacagaaucucuaucagaaugaaaaugcuuaugucucuguagugacuucaaauuauaacaggagauuuaccccggaaauagcagaaagacccaaaguaaaagaucaagcugggaggaugaacuauuacuggaccuugcuaaaacccggagacacaauaauauuugaggcaaauggaaaucuaauagcaccaauguaugcuuucgcacugaguagaggcuuuggguccggcaucaucaccucaaacgcaucaaugcaugaguguaacacgaagugucaaacaccccugggagcuauaaacagcagucucccuuaccagaauauacacccagucacaauaggagagugcccaaaauacgucaggagugccaaauugaggaugguuacaggacuaaggaacauuccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacacuguuaucgagaaaaugaacauucaauucacagcuguggguaaagaauucaacaaauuagaaaaaaggauggaaaauuuaaauaaaaaaguugaugauggauuucuggacauuuggacauauaaugcagaauuguuaguucuacuggaaaaugaaaggacucuggauuuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucuga

SEQ ID NO: 40671 - RNA, 1698 nt, Artificial Sequence
  hemagglutinin__InfluenzaA__AGQ47978
augaaggcaaaccuacugguccuguuaugugcacuugcagcugcagaugcagacacaauauguauaggcuaccaugcgaacaacucaaccgacacuguugacacaguacucgagaagaaugugacagugacacacucuguuaaccugcucgaagacagccacaacggaaaacuauguagauuaaaaggaauagccccacuacaauuggggaaauguaacaucgccggauggcucuugggaaacccagaaugcgacccacugcuuccagugggaucaugguccuacauuguagaaacaccaaacucugagaauggaauauguuauccaggagauuucaucgacuaugaggagcugagggagcaauugagcucagugucaucauucgaaagauucgaaauauuucccaaagaaagcucauggcccgaccacaacacaaacggaguaacggcagcaugcucccaugaggggaaaaacaguuuuuacagaaauuugcuauggcugacgaagaaggagagcucauacccagagcugaaaaauucuuaugugaacaaaaaagggaaagaaguccuuguacugugggguauucaucacccgccuaacaguaaggaacaacagaaucucuaucagaaugaaaaugcuuaugucucuguagugacuucaaauuauaacaggagauuuaccccggaaauagcagaaagacccaaaguaaaagaucaagcugggaggaugaacuauuacuggaccuugcuaaaacccggagacacaauaauauuugaggcaaauggaaaucuaauagcaccaauguaugcuuucgcacugaguagaggcuuuggguccggcaucaucaccucaaacgcaucaaugcaugaguguaacacgaagugucaaacaccccugggagcuauaaacagcagucucccuuaccagaauauacacccagucacaauaggagagugcccaaaauacgucaggagugccaaauugaggaugguuacaggacuaaggaacauuccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacacuguuaucgagaaaaugaacauucaauucacagcuguggguaaagaauucaacaaauuagaaaaaaggauggaaaauuuaaauaaaaaaguugaugauggauuucuggacauuuggacauauaaugcagaauuguuaguucuacuggaaaaugaaaggacucuggauuuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucuga

SEQ ID NO: 40672 - RNA, 1698 nt, Artificial Sequence
  hemagglutinin__InfluenzaA__AGQ47990
augaaggcaaaccuacugguccuguuaugugcacuugcagcugcagaugcagacacaauauguauaggcuaccaugcgaacaacucaaccgacacuguugacacaguacucgagaagaaugugacagugacacacucuguuaaccugcucgaagacagccacaacggaaaacuauguagauuaaaaggaauagccccacuacaauuggggaaauguaacaucgccggauggcucuugggaaacccagaaugcgacccacugcuuccagugggaucaugguccuacauuguagaaacaccaaacucugagaauggaauauguuauccaggagauuucaucgacuaugaggagcugagggagcaauugagcucagugucaucauucgaaagauucaaaauauuucccaaagaaagcucauggcccgaccacaacacaaacggaguaacggcagcaugcucccaugaggggaaaaacaguuuuuacagaaauuugcuauggcugacgaagaaggagagcucauacccagagcugaaaaauucuuaugugaacaaaaaagggaaagaaguccuuguacugugggguauucaucacccgccuaacaguaaggaacaacagaaucucuaucagaaugaaaaugcuuaugucucuguagugacuucaaauuauaacaggagauuuaccccggaaauagcagaaagacccaaaguaaaagaucaagcugggaggaugaacuauuacuggaccuugcuaaaacccggagacacaauaauauuugaggcaaauggaaaucuaauagcaccaauguaugcuuucgcacugaguagaggcuuuggguccggcaucaucaccucaaacgcaucaaugcaugaguguaacacgaagugucaaacaccccugggagcuauaaacagcagucucccuuaccagaauauacacccagucacaauaggagagugcccaaaauacgucaggagugccaaauugaggaugguuacaggacuaaggaacauuccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacacuguuaucgagaaaaugaacauucaauucacagcuguggguaaagaauucaacaaauuagaaaaaaggauggaaaauuuaaauaaaaaaguugaugauggauuucuggacauuuggacauauaaugcagaauuguuaguucuacuggaaaaugaaaggacucuggauuuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucuga

SEQ ID NO: 40673 - RNA, 1698 nt, Artificial Sequence
  hemagglutinin__InfluenzaA__AGQ48002
augaaggcaaaccuacugguccuguuaugugcacuugcagcugcagaugcagacacaauauguauaggcuaccaugcgaacaacucaaccgacacuguugacacaguacucgagaagaaugugacagugacacacucuguuaaccugcucgaagacagccacaacggaaaacuauguagauuaaaaggaauagccccacuacaauuggggaaauguaacaucgccggauggcucuugggaaacccagaaugcgacccacugcuuccagugggaucaugguccuacauuguagaaacaccaaacucugagaauggaauauguuauccaggagauuucaucgacuaugaggagcugagggagcaauugagcucagugucaucauucgaaagauucaaaauauuucccaaagaaagcucauggcccgaccacaacacaaacggaguaacggcagcaugcucccaugaggggaaaaacaguuuuuacagaaauuugcuauggcugacgaagaaggagagcucauacccagagcugaaaaauucuuaugugaacaaaaaaaggaaagaaguccuuguacugugggguauucaucacccgccuaacaguaaggaacaacagaaucucuaucagaaugaaaaugcuuaugucucuguagugacuucaaauuauaacaggagauuuaccccggaaauagcagaaagacccaaaguaaaagaucaagcugggaggaugaacuauuacuggaccuugcuaaaacccggagacacaauaauauuugaggcaaauggaaaucuaauagcaccaauguaugcuuucgcacugaguagaggcuuuggguccggcaucaucaccucaaacgcaucaaugcaugaguguaacacgaagugucaaacaccccugggagcuauaaacagcagucucccuuaccagaauauacacccagucacaauaggagagugcccaaaauacgucaggagugccaaauugaggaugguuacaggacuaaggaacauuccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacacuguuaucgagaaaaugaacauucaauucacagcuguggguaaagaauucaacaaauuagaaaaaaggauggaaaauuuaaauaaaaaaguugaugauggauuucuggacauuuggacauauaaugcagaauuguuaguucuacuggaaaaugaaaggacucuggauuuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucuga

SEQ ID NO: 40674 - RNA, 1698 nt, Artificial Sequence
  hemagglutinin__InfluenzaA__AGQ48014
augaaggcaaaccuacugguccuguuaugugcacuugcagcugcagaugcagacacaauauguauaggcuaccaugcgaacaacucaaccgacacuguugacacaguacucgagaagaaugugacagugacacacucuguuaaccugcucgaagacagccacaacggaaaacuauguagauuaaaaggaauagccccacuacaauuggggaaauguaacaucgccggauggcucuugggaaacccaggaugcgacccacugcuuccagugggaucaugguccuacauuguagaaacaccaaacucugagaauggaauauguuauccaggagauuucaucgacuaugaggagcugagggagcaauugagcucagugucaucauucgaaagauucaaaauauuucccaaagaaagcucauggcccgaccacaacacaaacggaguaacggcagcaugcucccaugaggggaaaaacaguuuuuacagaaauuugcuauggcugacgaagaaggagagcucauacccagagcugaaaaauucuuaugugaacaaaaaaaggaaagaaguccuuguacugugggguauucaucacccgccuaacaguaaggaacaacagaaucucuaucagaaugaaaaugcuuaugucucuguagugacuucaaauuauaacaggagauuuaccccggaaauagcagaaagacccaaaguaaaagaucaagcugggaggaugaacuauuacuggaccuugcuaaaacccggagacacaauaauauuugaggcaaauggaaaucuaauagcaccaauguaugcuuucgcacugaguagaggcuuuggguccggcaucaucaccucaaacgcaucaaugcaugaguguaacacgaagugucaaacaccccugggagcuauaaacagcagucucccuuaccagaauauacacccagucacaauaggagagugcccaaaauacgucaggagugccaaauugaggaugguuacaggacuaaggaacauuccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacacuguuaucgagaaaaugaacauucaauucacagcuguggguaaagaauucaacaaauuagaaaaaaggauggaaaauuuaaauaaaaaaguugaugauggauuucuggacauuuggacauauaaugcagaauuguuaguucuacuggaaaaugaaaggacucuggauuuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucuga

SEQ ID NO: 40675 - RNA, 1698 nt, Artificial Sequence
  hemagglutinin__InfluenzaA__AGQ48026
augaaggcaaaccuacugguccuguuaugugcacuugcagcugcagaugcagacacaauauguauaggcuaccaugcgaacaacucaaccgacacuguugacacaguacucgagaagaaugugacagugacacacucuguuaaccugcucgaagacagccacaacggaaaacuauguaaauuaaaaggaauagccccacuacaauuggggaaauguaacaucgccggauggcucuugggaaacccaggaugcgacccacugcuuccagugggaucaugguccuacauuguagaaacaccaaacucugagaauggaauauguuauccaggagauuucaucgacuaugaggagcugagggagcaauugagcucagugucaucauucgaaagauucaaaauauuucccaaagaaagcucauggcccgaccacaacacaaacggaguaacggcagcaugcucccaugaggggaaaaacaguuuuuacagaaauuugcuauggcugacgaagaaggagagcucauacccagagcugaaaaauucuuaugugaacaaaaaaaggaaagaaguccuuguacugugggguauucaucacccgccuaacaguaaggaacaacagaaucucuaucagaaugaaaaugcuuaugucucuguagugacuucaaauuauaacaggagauuuaccccggaaauagcagaaagacccaaaguaaaagaucaagcugggaggaugaacuauuacuggaccuugcuaaaacccggagacacaauaauauuugaggcaaauggaaaucuaauagcaccaauguaugcuuucgcacugaguagaggcuuuggguccggcaucaucaccucaaacgcaucaaugcaugaguguaacacgaagugucaaacaccccugggagcuauaaacagcagucucccuuaccagaauauacacccagucacaauaggagagugcccaaaauacgucaggagugccaaauugaggaugguuacaggacuaaggaacauuccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacacuguuaucgagaaaaugaacauucaauucacagcuguggguaaagaauucaacaaauuagaaaaaaggauggaaaauuuaaauaaaaaaguugaugauggauuucuggacauuuggacauauaaugcagaauuguuaguucuacuggaaaaugaaaggacucuggauuuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucuga

SEQ ID NO: 40676 - RNA, 1698 nt, Artificial Sequence
  hemagglutinin__InfluenzaA__AGQ48038
augaaggcaaaccuacugguccuguuaugugcacuugcagcugcagaugcagacacaauauguauaggcuaccaugcgaacaacucaaccgacacuguugacacaguacucgagaagaaugugacagugacacacucuguuaaccugcucgaagacagccacaacggaaaacuauguaaauuaaaaggaauagccccacuacaauuggggaaauguaacaucgccggauggcucuugggaaacccaggaugcgacccacugcuuccagugggaucaugguccuacauuguagaaacaccaaacucugagaauggaauauguuauccaggagauuucaucgacuaugaggagcugagggagcaauugagcucagugucaucauucgaaagauucaaaauauuucccaaagaaagcucauggcccgaccacaacacaaacggaguaacggcagcaugcucccaugaggggaaaaacaguuuuuacagaaauuugcuauggcugacgaagaaggagagcucauacccagagcugaaaaauucuuaugugaacaaaaaaagggaagaaguccuuguacugugggguauucaucacccgccuaacagugaggaacaacagaaucucuaucagaaugaaaaugcuuaugucucuguagugacuucaaauuauaacaggagauuuaccccggaaauagcagaaagacccaaaguaaaaggucaagcugggaggaugaacuauuacuggaccuugcuaaaacccggagacacaauaauauuugaggcaaauggaaaucuaauagcaccaauguaugcuuucgcacugaguagaggcuuuggguccggcaucaucaccucaaacgcaucaaugcaugaguguaacacgaagugucaaacaccccugggagcuauaaacagcagucucccuuaccagaauauacacccagucacaauaggagagugcccaaaauacgucaggagugccaaauugaggaugguuacaggacuaaggaacauuccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacacuguuaucgagaaaaugaacauucaauucacagcuguggguaaagaauucaacaaauuagaaaaaaggauggaaaauuuaaauaaaaaaguugaugauggauuucuggacauuuggacauauaaugcagaauuguuaguucuacuggaaaaugaaaggacucuggauuuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucuga

SEQ ID NO: 40677 - RNA, 1698 nt, Artificial Sequence
  hemagglutinin__InfluenzaA__AGQ48050
augaaggcaaaccuacugguccuguuaugugcacuugcagcugcagaugcagacacaauauguauaggcuaccaugcgaacaacucaaccgacacuguugacacaguacucgagaagaaugugacagugacacacucuguuaaccugcucgaagacagccacaacggaaaacuauguaaauuaaaaggaauagccccacuacaauuggggaaauguaacaucgccggauggcucuugggaaacccaggaugcgacccacugcuuccagugggaucaugguccuacauuguagaaacaccaaacucugagaauggaauauguuauccaggagauuucaucgacuaugaggagcugagggagcaauugagcucagugucaucauucgaaagauucaaaauauuucccaaagaaagcucauggcccgaccacaacacaaacggaguaacggcagcaugcucccaugaggggaaaaacaguuuuuacagaaauuugcuauggcugacgaagaaggagagcucauacccagagcugaaaaauucuuaugugaacaaaaaaagggaagaaguccuuguacugugggguauucaucacccgccugacagugaggaacaacagaaucucuaucagaaugaaaaugcuuaugucucuguagugacuucaaauuauaacaggagauuuaccccggaaauagcagaaagacccaaaguaaaaggucaagcugggaggaugaacuauuacuggaccuugcuaaaacccggagacacaauaauauuuaaggcaaauggaaaucuaauagcaccaauguaugcuuucgcacugaguagaggcuuuggguccggcaucaucaccucaaacgcaucaaugcaugaguguaacacgaagugucaaacaccccugggagcuauaaacagcagucucccuuaccagaauauacacccagucacaauaggagagugcccaaaauacgucaggagugccaaauugaggaugguuacaggacuaaggaacauuccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacacuguuaucgagaaaaugaacauucaauucacagcuguggguaaagaauucaacaaauuagaaaaaaggauggaaaauuuaaauaaaaaaguugaugauggauuucuggacauuuggacauauaaugcagaauuguuaguucuacuggaaaaugaaaggacucuggauuuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucuga

SEQ ID NO: 40678 - RNA, 1689 nt, Artificial Sequence
  hemagglutinin__InfluenzaA__AGQ80946
auggccaucauuuaucuaauucuucuguuuacagcagugagaggagaccagauaugcauuggauaccauuccaacaauuccacagaaaaggucgacacaauucuagagaggaaugucaccgugacucacgcucaagacauucuugagaagacucacaauggaaaauuaugcaaacugaauggaaucccuccacuugaauugggagauugcagcaucgccggauggcuccuugggaauccagaaugugauaggcuucuaacugugccagaauggucauauauaauggagaaagaaaauccaaggaacgguuugugcuacccaggcaguuucaaugauuaugaagaauugaaacaccuccuuaguaguguaacacacuucgagaaagugaagauuuugcccaaagauagauggacacagcauacaacaacuggagguucacgggccugcgcaguaucugguaauccgucauucuucaggaacauggucugguugacaaagaaagggccgaauuacccaguugccaaaggaucauacaauaauacaaguggggaccaaaugcugaucauuuggggggugcaucaccccaaugaugaagcugaacaaaggacauuguaucagaaugucgggacuuauguaucaguaggaacaucgacacugaacaaaagaucaguuccagaaauagccacaagaccuaaggugaauggacaaggaggcagaauggaauucucguggacuauauuggauguguuggacaccauaaauuucgagaguacugguaaucuaauugcaccggaauauggcuuuaaaauauccaaacgggguaguucaggaaucaugaaaacggaaggaacacuugaaaacugcgaaacuaaaugccaaacucccuugggagcaauaaauacaacauugcccuuucauaauauccacccacugaccauuggugagugccccaaauauguaaaaucggaaagguuagucuuggcaacaggauuaagaaaugucccucagauugaaucaagaggauuguuuggggcaauagcugguuuuauagaagggggauggcaaggaaugguugaugguugguauggauaucaucacagcaaugaucaaggauccggcuaugcagcagacaaagaguccacucaaaaggcaauugauggaaucaccaacaagguaaacucuguaauugagaaaaugaacacucaauucgaggcuguuggaaaagaauucaguaauuuggagaaaagacuggaaaaccugaauaaaaagauggaggacggauuccuagauguguggacauacaaugcugagcuucuaguucuaauggaaaaugagaggacacuugacuuucaugacuccaauguaaagaaucuauaugacaaagucagaaugcaacugagggacaaugcaaaagaacuagggaauggauguuuugaauuuuaucauaaaugugaugaugaaugcaugaauagcguaaagaaugggacauaugauuaucccaaguaugaagaggagucuaaacuaaacaggaaugagaucaaaggaguaaaauugagcaacauggggguuuaucaaauccuugcaauuuaugcuacaguagcaggcucccugucacuggcaaucaugauagcugggaucuccuuauggaugugcucuaacgggucucugcaaugcaggaucugcauauga

SEQ ID NO: 40679 - RNA, 1689 nt, Artificial Sequence
  hemagglutinin__InfluenzaA__AGQ80947
auggccaucauuuaucuaauucuuuuguuugcaacagugagaggagaccagauaugcauuggauaccacuccaacaauuccacagaaaagguagacacaauucuagagaggaauaucacugugacucacgcucaggacauucuugagaagacucacaauggaaaauuaugcaaacuaaauggaaucccuccacuugaauugggaaacugcagcaucgcuggauggcuccuuggaaauccagaaugugauaggcuucuaacugugccagaauggucauauauaauggagaaagaaaauccaagggaugguuugugcuacccaggcaguuucaaugacuaugaagaauugaaacaccuccuuaguaguguaacacacuucgagaaagugaagauuuugcccaaagauagguggacacagcauacaacaacuggagguucacgggcuugcgcaguaucugguaacccgucauucuucagaaacauggucugguugacaaagaaagggucgaauuacccaauugccaagggaucauacaauaauacaaguggggaacaaaugcugaucauuuggggaguacaucaucccaaugaugaugcugaacaaagaacauuguaucagaacgucgggaccuauguaucaguggggacaucgacauugaacaaaagaucaaucccagaaauagccacaagaccuaaagugaauggacagggaggcagaauggaauucucguggacuauauuggauauguuggacaccauaaacuuugagaguacugguaaucuaauugcaccagaauauggauuuaaaauauccaaacgggguagcucagggaucaugaaaacagaagggacacuugaaaacugcgaaacuaaaugccaaacucccuugggagcaauaaauacaacauugcccuuccauaauauccauccauugaccauuggugaaugucccaaauaugucaaaucagagagguuaguuuuggcaacaggauuaagaaaugucccucaaauugaaucaagagggcuguuuggggcaauagcugguuucauagaagggggauggcaaggaaugguugaugguugguauggauaucaucacagcaaugaucaaggauccggguaugcagcagacaaagaguccacucaaaaggcaauugauggaaucaccaauaagguaaacucuguaauugagaaaaugaacacccaauucgaggcuguugggaaagaauucaauaauuuggagaaaagacuggaaaaccugaauaaaaagauggaggacggauuccuagauguguggacauacaaugcugagcuucuaguucuaauggaaaaugaaagaacacuugacuuccaugacuccaaugucaagaaucuauaugacaaagucagaaugcaauugaaggacaaugcaaaagaacuagggaauggauguuucgaauuuuaccauaaaugugaugaugaaugcaugaauaguguaaagaaugggacauaugauuaucccaaauaugaagaggagucuaaauuaaacaggaaugagaucaaaggagucaaauugagcaacauggggguuuaucaaauccuugcaauuuaugcuacaguggcaggcuccuugucacuggcaaucaugauagcuggggucuccuuauggaugugcucuaacgggucucugcaaugcaggaucugcauauga

SEQ ID NO: 40680 - RNA, 1689 nt, Artificial Sequence
  hemagglutinin__InfluenzaA__AGQ80948
auggccaucauuuaucuaauucuuuuguuugcagcagugagaggagaccagauaugcauuggauaccacuccaacaauuccacagaaaagguagacacaauucuagagaggaaugucacugugacucacgcucaagacauucuugagaagacucacaauggaaaauuaugcaaacuaaauggaaucccuccacuugaauugggaaacugcagcaucgcuggauggcuccuuggaaauccagaaugugauaggcuccuaacugugccagaauggucauauauaauggagaaagaaaauccaaggaaugguuugugcuacccaggcaguuucaaugacuaugaagaauugaaacaccuccuuaguaguguaacacacuucgagaaagugaagauuuugcccaaagauagguggacacagcauacaacaacuggagguucacgggcuugcgcaguauuugguaacccgucauucuucagaaacauggucugguugacaaagaaagggucgaauuacccaauugccaagggaucauacaauaauacaaguggggaacaaaugcugaucauuuggggaguacaucaucccaaugaugaugcugaacaaagaacauuguaucagaacgucgggaccuauguaucaguggggacaucgacauugaacaaaagaucaaucccagaaauagccacaagaccuaaagugaauggacagggaggcagaauggaauucucguggacuauauuggauauguuggacaccauaaacuuugagaguacugguaaucuaauugcaccagaauauggauuuaaaauauccaaacgggguagcucagggaucaugaaaacagaagggacacuugaaaacugcgaaacuaaaugucaaacucccuugggagcaauaaauacaacauugcccuuccauaauauccauccauugaccauuggugaaugucccaaauauguaaaaucagagagguuagucuuggcaacaggauuaagaaaugucccucaaauugaaucaagagggcuguuuggggcaauagcugguuucauagaagggggauggcaaggaaugguugaugguugguauggauaucaucacagcaaugaucaaggauccggguaugcagcagacaaagaguccacucaaaaggcaauugauggaaucaccaauaaggucaacucuguaaucgagaaaaugaacacccaauucgaggcuguugggaaagaauucaauaauuuggagaaaagacuggaaaaccugaauaaaaagauggaggacggauuccuagauguguggacauacaaugcugagcuucuaguucuaauggaaaaugaaagaacacuugacuuccaugacuccaaugucaagaaucuauaugacaaaaucaggaugcaauugaaggacaaugcaaaagaacuagggaauggauguuucgaauuuuaccauaaaugugaugaugaaugcaugaauagcguaaagaaugggacauaugauuaucccaaauaugaagaggagucuaaauuaaacaggaaugagaucaaaggggucaaauugagcaacauggggguuuaucaaauccuugcaauuuaugcuacaguggcaggcuccuugucacuggcaaucaugauagcugggaucuccuuauggaugugcucuaacgggucucugcaaugcaggaucugcauauga

SEQ ID NO: 40681 - RNA, 1689 nt, Artificial Sequence
  hemagglutinin__InfluenzaA__AGQ80949
auggccaucauuuaucuaauucuuuuguuugcagcagugagaggagaccagauaugcauuggauaccacuccaacaauuccacagaaaagguagacacaauucuagagaggaaugucacugugacucacgcucaagacauucuugagaagacucacaauggaaaauuaugcaaacuaaauggaaucccuccacuugaauugggagacugcagcaucgcuggauggcuccuuggaaauccagaaugugauaggcuucuaacugugccagaauggucauauauaauggagaaagaaaauccaaggaaugguuugugcuacccaggcaguuucaaugacuaugaagaauugaaacaccuccuuaguaguguaacacacuucgagaaagugaagauuuugcccaaagauagguggacacagcauacaacaacuggagguucacgggcuugcgcaguaucugguaacccgucauucuucagaaacauggucugguugacaaagaaagggucgaauuacccaauugccaagggaucauacaauaauacaaguggggaacaaaugcugaucauuuggggaguacaucaucccaaugaugaugcugaacaaagaacauuguaucagaacgucgggaccuauguaucaguggggacaucgacauugaacaaaagaucaaucccagaaauagccacaagaccuaaagugaauggacagggaggcagaauggaauucucguggacuauauuggauauguuggacaccauaaacuuugagaguacugguaaucuaauugcaccagaauauggauuuaaaauauccaaacgggguagcucagggaucaugaaaacagaagggacacuugaaaacugcgaaacuaaaugucaaacucccuugggagcaauaaauacaacauugcccuuccauaauauccauccauugaccauuggugaaugucccaaauauguaaaaucagagagguuagucuuggcaacaggauuaagaaaugucccucaaauugaaucaagagggcuguuuggggcaauagcugguuucauagaagggggauggcaaggaaugguugaugguugguauggauaucaucacagcaaugaucaaggauccggguaugcagcagacaaagaguccacucaaaaggcaauugauggaaucaccaauaaggucaacucuguaauugagaaaaugaacacccaauucgaggcuguugggaaagaauucaauaauuuggagaaaagacuggaaaaccugaauaaaaagauggaggacggauuccuagauguguggacauacaaugcugagcuucuaguucuaauggaaaaugaaagaacacuugacuuccaugacuccaaugucaagaaucuauaugacaaaaucaggaugcaauugaaggacaaugcaaaagaacuagggaauggauguuucgaauuuuaccauaaaugugaugaugaaugcaugaauagcguaaaaaaugggacauaugauuaucccaaauaugaagaggagucuaaauuaaacaggaaugagaucaaaggggucaaauugagcaacauggggguuuaucaaauccuugcaauuuaugcuacaguggcaggcuccuugucacuggcaaucaugauagcugggaucuccuuauggaugugcucuaacgggucucugcaaugcaggaucugcauauga

SEQ ID NO: 40682 - RNA, 1701 nt, Artificial Sequence
  hemagglutinin__InfluenzaA__AGQ80950
augaagaccauuauugccuugagcuacauuuucugccuggccuuuggucagaaccuuccagggaaugacagcaguacagcaacacugugccugggacaucaugcggugcugaacgggacaauagugaagacaaucaccgaugaucagauugaggugacuaaugcuaccgagcugguucaaagcucuucaacagggaaaauaugcaacaauccucauaagauccuugauggaagggacugcacacuaauagaugcccugcugggggauccucauugcgaugucuuucaagaugaaacaugggaucuuuuuguggagcgaagcagcgcuuucagcaauuguuacccuuaugauguaccagauuaugccucccuucgaucccuaguugcuucaucaggcacacuagaguucaucacugaggguuucacuuggacaggaguaagccagaauggagggagcggugccugcaaaagaggaccugccaacggcuucuucaguagauugaacugguugacuaagucaggaaacgcauauccaguguugaacgugacuaugccaaacagugacaauuuugacaaacuauacaucugggguguucaccacccgagcacaaaucaagaacagaccaaccuguauguucaagccucagggagggucacagucucuaccagaagaagucaacagacuauaaucccaaauauuggaucuagacccugggugaggggccagucuggcagaauaagcaucuauuggacaauagucaaaccuggggacguacugguaaucaauaguaauggaaaucuaauugcuccucggggcuauuucaagaugcggacugggaaaagcucaauaaugagaucagaugcaccuauugaaacuugcauuucagaaugcauuacuccaaauggaagcaucccuaaugacaagcccuuucaaaauguaaacaagaucacauacggagcaugucccaaauaugugaagcagaauacucuaaaguuagcaacaggaaugcggaauguaccugagaaacaaaccagaggucuauucggugcaauagcaggguucauagaaaaugggugggaaggaaugauagaugguugguauggcuucaggcaccaaaacuccgaagguacagggcaagcagcagaccuuaaaagcacucaagcggccauugaccagaucaaugggaaauugaacagggugauugaaaagacgaaugagaaauuccaucaaaucgaaaaggaauucucugagguagaaggaaggauucaggaucuugagaaauacguugaagacacaaagauagaucucuggucuuacaaugcagaacuucuuguugcccuagagaaccagcauacaauugauuugacugauucagagaugaacaaauuguuugaaaagaccaggaggcaacugagagagaaugcugaagacaugggcaaugguugcuucaagauauaccacaagugugacaaugcuugcauagaaucaauuagaaacgggacuuaugaccaugacauauaccgagaugaggcacugaacaaccgguuccagaucaaagguguugagcuaaaaucuggguacaaagacuggauccuguggauuuccuuugccauaucaugcuuuuugcuuuguguugucuuguugggguucauuaugugggccugccagagaggcaacauuaggugcaacauuugcauuuga

SEQ ID NO: 40683 - RNA, 1695 nt, Artificial Sequence
  hemagglutinin__InfluenzaA__AGQ80951
augcuaucaauugugauuuuguuucugcuuguugcagagagcucuucucaaaacuacacaggaaacccugugauaugcaugggacaucaugcuguggccaaugggacuaugguaaagacccucacugaugaucaaguggaaguggucacugcacaagaacugguggaaucacagaaccucccggaacuaugcccgaguccucuaagacuagucgauggccagaccugugauaucaucaauggagccuuaggaagcccaggaugugaccauuugaauggugcugaaugggacauuuucauagaaaggcccaaugcaauggacacuugcuauccauuugaugugccagauuaucagagccuaaggagcauacucgccaacaaugggaaauucgaauucauugcugaagaauuccaauggagcaccgugaagcaaaauggcaaauccggggccugcaagagggcaaaugugaacgauuucuuuaauagacugaauuggcucgugaagucagacgggaaugcauacccucuccagaauuugacaaaaguaaacaacggugauuaugcgaggcuuuacaucuggggaguucaccacccuucgacggauaccgagcaaaccaaccuguauaagaacaauccugguagggucacuguaucuaccaaaaccagucaaacaaguguggugcccaacauuggcagcaggccuugggugagaggacaaaguggcagaaucagcuucuauuggacuauuguagagccuggagauuugauagucuucaacacaauaggaaauuuaauugccccaagaggacauuacaaauuaaacagucagaagaagagcacaauucugaacacugcaacucccauaggcucaugugucaguaaaugucauacagacaaagguucucucucuaccaccaagcccuuucaaaauaucucaaggguagcaauuggagauugucccaaauaugucaaacaaggcucccuaaaacuugcaacugggaugagaaauaucccugagaaggcaucaagagggcuuuuuggagcaauagcuggauucauagagaauggauggcaaggccugauugaugguugguauggcuucagacaucaaaaugcagaaggaacaggaacagcugcugaucuaaaauccacucaggcagccaucgaucagaucaaugggaaacucaaucgucuuauugagaaaacaaacgagaaauaccaucaaaucgaaaaagaguucgaacaaguugaaggaagaauccaagaccuggagaaauauguugaagacacaaagauugaucuauggucauauaaugcagagcuauuagucgcucuggaaaaccagcauacuauagaugugacugacucggagaugaacaagcucuuugaaagaguaaggcgacaacucagggagaaugcugaagacaaaggaaauggauguuuugaaauauuccacaaaugugacaacaacugcauugaaagcauucggaaugggaccuaugaucaugauguuuauagaaaugaagcgaucaacaaucgauuccaaauacagggugucaaauugacccagggauacaaggacaucauccuuuggauuucguucuccauaucaugcuuuuugcucguagcacugcuuuuggccuucauuuugugggcuugucagaacggaaacauccggugccagauuugcauuuga

SEQ ID NO: 40684 - RNA, 1683 nt, Artificial Sequence
  hemagglutinin__InfluenzaA__AGQ80953
augaacacucaaauccugguauucgcucugguugcgaucauuccgacaaaugcagacaaaaucugccucggacaucaugcugugucaaacggaacuaaaguaaacacauuaacugaaagaggaguggaagucguuaaugcaacugaaacaguggaacgaacaagcauccccaggaucugcucaaaagggaaaagggcaguugaccucggucaauguggacuccuggguacaaucacugggccaccccaaugugaccaauuccuagaauuuucagccgauuugauuauugagaggcgagaaggaagugaugucuguuauccugggaaguuuguaaaugaagaagcuuugaggcaaauucucagggaaucaggcggaauugacaaggaaacaaugggauucacauacagcggaauaagaacuaauggagcaaccagugcauguaggagaucaggaucuucauucuaugcagaaaugaaauggcuccugucaaacacagauaaugcugcuuucccgcagacgacuaaaucauacaaaaauacaaggaaagacccagcuuuaauaauaugggggauucaccauucuggaucaacuacagaacagaccaagcuauaugggaguggaaacaaacugauaacaguugggaguucuaauuaucaacagucuuuugugccgaguccaggagcgagaccacaaguuaauggccaaucuggaaggauugacuuucauuggcugaugcuaaaccccaaugauacagucacuuucaguuucaauggggccuucauagcuccagaccgugcaagcuuccugagaggaaaaucuaugggaauucagaguggaguacagguugaugccaauugugaaggggauugcuaucacaauggagggacaauaauaaguaauuugcccuuucagaacauaaauagcagggcaguagggaaauguccgagauauguuaagcaagagagucugcugcuagcaacagggaugaagaauguucccgagauuccaaagggaagaggucuauuuggugcuauagcagguuucauugaaaauggaugggaaggucuaauugaugggugguaugguuucaggcaucaaaaugcacagggagaggggacugcugcagauuacaaaagcacucagucggcaauugaucaaauaacagggaaauuaaaccggcuuauagaaaaaaccaaccaacaauuugaguuaauagacaaugaguucacugagguugaaaggcaaauugguaauguaauaaauuggaccagagacuccaugacagaggugugguccuacaaugcugaacucuuaguagcaauggagaaccagcacacaauugaucuggcugauucagaaaugaauaaacuauacgaacgagugaggagacagcugagagagaaugcugaagaagauggcaccgguugcuuugaaauauuucacaagugugaugaugacuguauggccaguauuagaaauaacaccuaugaucacagcaaguacagggaagaggcaaugcaaaauagaauacagauugauccagucaaacuaagcaguggcuacaaagaugugauacuuugguuuagcuucggggcaucauguuucauacuucuggccauugcaaugggccuugucuucauaugugugaagaauggaaacaugcggugcacuauuuguauauaa

SEQ ID NO: 40685 - RNA, 1683 nt, Artificial Sequence; identical to SEQ ID NO: 40684
  hemagglutinin__InfluenzaA__AGQ80954

SEQ ID NO: 40686 - RNA, 1683 nt, Artificial Sequence; identical to SEQ ID NO: 40684
  hemagglutinin__InfluenzaA__AGQ80955

SEQ ID NO: 40687 - RNA, 1683 nt, Artificial Sequence; identical to SEQ ID NO: 40684
  hemagglutinin__InfluenzaA__AGQ80956

SEQ ID NO: 40688 - RNA, 1683 nt, Artificial Sequence; identical to SEQ ID NO: 40684
  hemagglutinin__InfluenzaA__AGQ80957

SEQ ID NO: 40689 - RNA, 1683 nt, Artificial Sequence; identical to SEQ ID NO: 40684
  hemagglutinin__InfluenzaA__AGQ80958

SEQ ID NO: 40690 - RNA, 1683 nt, Artificial Sequence
  hemagglutinin__InfluenzaA__AGQ80959
augaacacucaaauccugguauucgcucugauugcgaucauuccaacaaaugcagacaaaaucugccucggacaucaugcugugucaaacggaaccaaaguaaacacauuaacugaaagaggaguggaagucgucaaugcaacugaaacaguggaacgaacaaacauccccaggaucugcucaaaagggaaaagaacaguugaccucggucaauguggacuccuggggacaaucacugggccaccucaaugugaccaauuccuagaauuuucagccgauuuaauuauugagaggcgagaaggaagugauguuuguuauccugggaaauucgugaaugaagaagcucugaggcaaauucucagggaaucaggcggaaucgacaaggaagcaaugggauucacauacagcggaauaagaacuaauggagcaaccagugcauguaggagaucaggaucuucauucuaugcagaaaugaaauggcuccuaucaaacacagauaaugcugcuuucccgcagaugacuaagucauauaaaaauacaagaaaggacccagcucuaauaauaugggggauccaucauuccggaucaacugcagagcaaaccaagcuauaugggaguggaaacaaacuagugacaguugggaguucuaauuaucaacaaucuuuugugccgaguccaggagcgagaccacaaguuaauggucagucuggaaggauugacuuucauuggcuaaugcuaaaucccaaugacacagucaccuucagcuucaauggggcuuucauagcuccagaccgugcaagcuuccugagagggaaaucuaugggaauccagaguggaguacagguugaugccaauugugaaggagacugcuaucaugguggagggacaauaauaaguaacuugccauuucaaaacauagacagcagagcaguaggaaaauguccgagauauguuaagcaaaagagucugcugcuagcaacagggaugaagaauguuccugagaguccaaagggaagaggccuauuuggugcuauagcggguuucauugaaaauggaugggaaggccuaauugaugggugguaugguuucagacaccagaaugcacagggagagggaacugcugcagauuacaaaagcacucaaucggcaauugaucaaauaacaggaaaauuaaaccggcuuauagaaaaaaccaaccaacaauuugaguugauagacaaugaauucacugagguagagaagcaaaucgguaaugugauaaauuggaccagagacucuauaacggaaguguggucauacaaugcugagcucuugguagcaauggagaaccagcauacaauugaucuggcugauucagaaaugaacaaacuguacgaacgagugaaaagacagcugagagagaaugcugaagaagauggcacugguugcuuugaaauauuucacaaaugugaugaugacuguauggccaguauuagaaauaacaccuaugaucacagcaaauacagggaagaagcaaugcaaaauagaauacagauugacccagucaaacuaagcagcggcuacaaagaugugauacuuugguuuagcuucggggcaucauguuucauacuucuagccauugcaaugggccuugucuucauaugugugaagaauggaaacaugcggugcacuauuuguauauaa

SEQ ID NO: 40691 - RNA, 1683 nt, Artificial Sequence
  hemagglutinin__InfluenzaA__AGQ80961
augaacacucaaauccugguauucgcucugguggcgaucauuccgacgaaugcagacaagaucugucuugggcaccaugccgugucaaacgggacuaaaguaaacacauuaacugaaagaggaguggaagucguuaaugcaacugaaacgguugaacgaacaaauguucccaagaucugcucaaaaggaaaaaggacaguugaccucggucaauguggacuucugggaacaauaacugggccaccccaaugugaccaauuccuagaauuuucagccgauuuaauuauugagaggcgagaaggaagugaugucuguuauccugggaaauucgugaaugaagaaacucugaggcaaauucucagggagucaggcggaauugacaaggagacgaugggguucacauacagcggaauaagaacuaauggagcaaccagugcauguagaagaucaggaucuucauucuaugcagaaaugaaauggcuccugucaaacacagacaaugcugcuuucccgcagaugacuaagucauacaaaaacgcaaggaaagacccagcucugauaauaugggggauccaccauuccggaucaaccacagaacagaccaagcuauacgggaguggaaacaaauugauaacaguugggaguucuaauuaccaacaguccuuuguaccgaguccgggagcgaggccacaagugaauggccaaucuggaaggauugauuuucauuggcugaugcugaaccccaaugauacaguuacuuucaguuucaauggggccuucauagcuccagaccgugcaugcuuucugagagggaaguccaugggaauucagaguggaguacagguugaugccaguugugaaggagauugcuaucauaguggagggacaauaauaaguaauuugcccuuucagaacauaaauagcagggcaguagggaaauguccgagauauguuaagcaggagagucugaugcuggcgacaggaaugaagaauguuccugaaaucccaaagggaagaggccuguuuggugcuauagcggguuucauugaaaauggaugggaaggucugauugacggaugguauggcuucaggcaucaaaaugcacaaggggagggaacugcugcagauuacaagagcacccaaucagcaauugaucaaauaacagggaaauuaaaccggcuuauagaaaaaacuaaccaacaauuugaguuaauagacaaugaauucacugagguugaaaagcaaauugguaaugugauaaauuggaccagagauuccaugacagaaguguggucauauaacgcugaacucuugguagcaauggagaaucagcacacaaucgaucuggccgacucagaaaugaacaaacuauacgaacgggugaagaggcaacugagagagaaugcugaagaagauggcacugguuguuuugaaauauuucacaagugugaugacgacuguauggccaguauuagaaacaacacuuaugaucacagcaaguacagggaagaggcaaugcaaaauagaauaaagauugacccggucaaacuaagcagcggcuacaaagaugugauacuuugguuuagcuucggggcaucauguuucauacuucuggccauugcaaugggccuugucuucauaugugugaagaacggaaacaugcggugcacuauuuguauauaa

SEQ ID NO: 40692 - RNA, 1683 nt, Artificial Sequence; identical to SEQ ID NO: 40691
  hemagglutinin__InfluenzaA__AGQ80962

SEQ ID NO: 40693 - RNA, 1683 nt, Artificial Sequence
  hemagglutinin__InfluenzaA__AGQ80964
augaacacucaaauccugguauucgcucugauugcgaucauuccaacaaaugcagacaaaaucugccuuggacaucaugcugugucaaacggaacuaaaguaaacacauuaacugaaagaggaguggaagucguuaaugcaacugaaacaguggaacggacaaacauccccaggaucugcucaaaggggaaaaggacaguugaccucggucaauguggacuccuggggacaaucacuggaccaccucaaugugaccaauuccuagaauuuucagccgauuuaauuauugagaggcgagaaggaagugaugucuguuauccugggaaauucgugaaugaagaagcucugaggcaaauucucagggaaucaggcggaauugacaaggaagcaaugggauucacauacagcggaauaagaacuaauggagcaaccagugcauguaggagaucagggucuucauucuaugcagaaaugaaauggcuccugucaaacacagauaaugcugcuuucccgcagaugacuaagucauauaaaaauacaaggaaagacccagcucuaauaauaugggggauccaucauuccggaucaacugcagagcaaaccaagcuauaugggaguggaaacaaacuggugacaguugggaguucuaauuaucaacaaucuuuugugccgaguccaggagcgagaccacaaguuaauggucaaucuggaaggauugacuuucauuggcuaaugcugaaucccaaugauacugucaccuucaguuucaauggggcuuucauagcuccagaccgugcaagcuuccugagagggaaaucuaugggaauucagaguggaguacagguugaugccgauugugaaggggauugcuaucauaguggagggacaauaauaaguaauuugccauuucagaacauagauagcagggcaguaggaaaauguccgagauauguuaagcaaaggagucugcugcuagcaacagggaugaagaauguuccugagauuccaaagggaagaggccuauuuggugcuauagcggguuucauugaaaauggaugggaaggccuaauugaugggugguaugguuucaggcaccagaaugcacagggagagggaacugcugcagauuacaaaagcacucaaucggcaauugaucaaauaacaggaaaauuaaaccggcuuauagaaaaaaccaaccaacaauuugaguugauagacaaugaguucacugagguagagaagcaaaucgguaaugugauaaauuggaccagagacucuauaacagaaguguggucauacaaugcugaacucuugguagcaauggagaaccagcauacgauugaucuggcugauucagaaaugaauaaacuguacgaacgagugaaaagacagcugagagagaaugcugaagaagauggcacugguugcuuugaaauauuucacaagugugaugaugacuguauggccaguauuagaaauaacaccuaugaucacagcaaauacagggaagaggcaaugcaaaauagaauacagauugacccagucaaacuaagcaguggauacaaagaugugauacuuugguuuagcuucggggcaucauguuucauacuucuagccauugcaaugggccuugucuucauaugugugaagaauggaaacaugcggugcacuauuuguauauaa

SEQ ID NO: 40694 - RNA, 1683 nt, Artificial Sequence; identical to SEQ ID NO: 40684
  hemagglutinin__InfluenzaA__AGQ80965

SEQ ID NO: 40695 - RNA, 1683 nt, Artificial Sequence; identical to SEQ ID NO: 40684
  hemagglutinin__InfluenzaA__AGQ80966

SEQ ID NO: 40696 - RNA, 1683 nt, Artificial Sequence
  hemagglutinin__InfluenzaA__AGQ80968
augaacacucaaauccugguauucgcucugguugcgaucauuccgacaaaugcagacaaaaucugccucggacaucaugcugugucaaacggaacuaaaguaaacacauuaacugaaagaggaguggaagucguuaaugcaacugaaacaguggaacgaacaagcauccccaggaucugcucaaaagggaaaagggcaguugaccucggucaauguggacuccuggguacaaucacugggccaccccaaugugaccaauuccuagaauuuucagccgauuugauuauugagaggcgagaaggaagugaugucuguuauccugggaaguuuguaaaugaagaagcuuugaggcaaauucucagggaaucaggcggaauugacaaggaaacaaugggauucacauacagcggaauaagaacuaauggagcaaccagugcauguaggagaucaggaucuucauucuaugcagaaaugaaauggcuccugucaaacacagauaaugcugcuuucccgcagacgacuaaaucauacaaaaauacaaggaaagacccagcuuuaauaauaugggggauucaccauucuggaucaacuacagaacagaccaagcuauaugggaguggaaacaaacugauaacaguugggaguucuaauuaucaacagucuuuugugccgaguccaggagcgagaccacaaguuaauggccaaucuggaaggauugacuuucauuggcugaugcuaaaccccaaugauacagucacuuucaguuucaauggggccuucauagcuccagaccgugcaagcuuccugagaggaaaaucuaugggaauucagaguggaguacagguugaugccaauugugaaggggauugcuaucacaauggagggacaauaauaaguaauuugcccuuucagaacauaaauagcagggcaguagggaaauguccgagauauguuaagcaagagagucugcugcuagcaacaggaaugaagaauguucccgagauuccaaagggaagaggucuauuuggugcuauagcagguuucauugaaaauggaugggaaggucuaauugaugggugguaugguuucaggcaucaaaaugcacagggagaggggacugcugcagauuacaaaagcacucagucggcaauugaucaaauaacagggaaauuaaaccggcuuauagaaaaaaccaaccaacaauuugaguuaauagacaaugaguucacugagguugaaaggcaaauugguaauguaauaaauuggaccagagacuccaugacagaggugugguccuacaaugcugaacucuugguagcaauggagaaccagcacacaauugaucuggcugauucagaaaugaauaaacuauacgaacgagugaggagacagcugagagagaaugcugaagaagauggcaccgguugcuuugaaauauuucacaagugugaugaugacuguauggccaguauuagaaauaacaccuaugaucacagcaaguacagggaagaggcaaugcaaaauagaauacagauugauccagucaaacuaagcaguggcuacaaagaugugauacuuugguuuagcuucggggcaucauguuucauacuucuggccauugcaaugggccuugucuucauaugugugaagaauggaaacaugcggugcacuauuuguauauaa

SEQ ID NO: 40697 - RNA, 1683 nt, Artificial Sequence
  hemagglutinin__InfluenzaA__AGQ80970
augaacacucaaauccugguauucgcucugguugcgaucauuccgacaaaugcagacaaaaucugccucggacaucaugcugugucaaacggaacuaaaguaaacacauuaacugaaagaggaguggaagucguuaaugcaacugaaacaguggaacgaacaagcauccccaggaucugcucaaaagggaaaaaggcaguugaccucggucaauguggacuccuggguacaaucacugggccaccccaaugugaccaauuccuagaauuuucagccgauuugauuauugagaggcgagaaggaagugaugucuguuauccugggaaguuuguaaaugaagaagcuuugaggcaaauucucagggaaucaggcggaauugacaaggaaacaaugggauucacauacagcggaauaagaacuaauggagcaaccagugcauguaggagaucaggaucuucauucuaugcagaaaugaaauggcuccugucaaacacagauaaugcugcuuucccgcagacgacuaaaucauacaaaaauacaaggaaagacccagcuuuaauaauaugggggauucaccauucuggaucaacuacagaacagaccaagcuauaugggaguggaaacaaacugauaacaguugggaguucuaauuaucaacagucuuuugugccgaguccaggagcgagaccacaaguuaauggccaaucuggaaggauugacuuucauuggcugaugcuaaaccccaaugauacagucacuuucaguuucaauggggccuucauagcuccagaccgugcaagcuuccugagaggaaaaucuaugggaauucagaguggaguacagguugaugccaauugugaaggggauugcuaucacaauggagggacaauaauaaguaauuugcccuuucagaacauaaauagcagggcaguagggaaauguccgagauauguuaagcaagagagucugcugcuagcaacagggaugaagaauguucccgagauuccaaagggaagaggucuauuuggugcuauagcagguuucauugaaaauggaugggaaggucuaauugaugggugguaugguuucaggcaucaaaaugcacagggagaggggacugcugcagauuacaaaagcacucagucggcaauugaucaaauaacagggaaauuaaaccggcuuauagaaaaaaccaaccaacaauuugaguuaauagacaaugaguucacugagguugaaaggcaaauugguaauguaauaaauuggaccagagacuccaugacagaggugugguccuacaaugcugaacucuuaguagcaauggagaaccagcacacaauugaucuggcugauucagaaaugaauaaacuauacgaacgagugaggagacagcugagagagaaugcugaagaagauggcaccgguugcuuugaaauauuucacaagugugaugaugacuguauggccaguauuagaaauaacaccuaugaucacagcaaguacagggaagaggcaaugcaaaauagaauacagauugauccagucaaacuaagcaguggcuacaaagaugugauacuuugguuuagcuucggggcaucauguuucauacuucuggccauugcaaugggccuugucuucauaugugugaagaauggaaacaugcggugcacuauuuguauauaa

SEQ ID NO: 40698 - RNA, 1683 nt, Artificial Sequence
  hemagglutinin__InfluenzaA__AGQ80971
augaacacucaaauccugguauucgcucugguugcgaucauuccgacaaaugcagacaaaaucugccucggacaucaugcugugucaaacggaacuaaaguaaacacauuaacugaaagaggaguggaagucguuaaugcaacugaaacaguggaacgaacaagcauccccaggaucugcucaaaagggaaaaagacaguugaccucggucaauguggacuccuggguacaaucacugggccaccccaaugugaccaauuccuagaauuuucagccgauuugauuauugagaggcgagaaggaagugaugucuguuauccugggaaguuuguaaaugaagaagcuuugaggcaaauucucagggaaucaggcggaauugacaaggaaacaaugggauucacauacagcggaauaagaacuaauggagcaaccagugcauguaggagaucaggaucuucauucuaugcagaaaugaaauggcuccugucaaacacagauaaugcugcuuucccgcagacgacuaaaucauacaaaaauacaaggaaagacccagcuuuaauaauaugggggauucaccauucuggaucaacuacagaacagaccaagcuauaugggaguggaaacaaacugauaacaguugggaguucuaauuaucaacagucuuuugugccgaguccaggagcgagaccacaaguuaauggccaaucuggaaggauugacuuucauuggcugaugcuaaaccccaaugauacagucacuuucaguuucaauggggccuucauagcuccagaccgugcaagcuuccugagaggaaaaucuaugggaauucagaguggaguacagguugaugccaauugugaaggggauugcuaucacaauggagggacaauaauaaguaauuugcccuuucagaacauaaauagcagggcaguagggaaauguccgagauauguuaagcaagagagucugcugcuagcaacagggaugaagaauguucccgagauuccaaagggaagaggucuauuuggugcuauagcagguuucauugaaaauggaugggaaggucuaauugaugggugguaugguuucaggcaucaaaaugcacagggagaggggacugcugcagauuacaaaagcacucagucggcaauugaucaaauaacagggaaauuaaaccggcuuauagaaaaaaccaaccaacaauuugaguuaauagacaaugaguucacugagguugaaaggcaaauugguaauguaauaaauuggaccagagacuccaugacagaggugugguccuacaaugcugaacucuuaguagcaauggagaaccagcacacaauugaucuggcugauucagaaaugaauaaacuauacgaacgagugaggagacagcugagagagaaugcugaagaagauggcaccgguugcuuugaaauauuucacaagugugaugaugacuguauggccaguaucagaaauaacaccuaugaucacagcaaguacagggaagaggcaaugcaaaauagaauacagauugauccagucaaacuaagcaguggcuacaaagaugugauacuuugguuuagcuucggggcaucauguuucauacuucuggccauugcaaugggccuugucuucauaugugugaagaauggaaacaugcggugcacuauuuguauauaa

SEQ ID NO: 40699 - RNA, 1683 nt, Artificial Sequence
  hemagglutinin__InfluenzaA__AGQ80974
augaacacucaaauccugguauucgcucugguugcgaucauuccgacaaaugcagacaaaaucugccucggacaucaugcugugucaaacggaacuaaaguaaacacauuaacugaaagaggaguggaagucguuaaugcaacugaaacaguggaacgaacaagcauccccaggaucugcucaaaagggaaaagggcaguugaccucggucaaugugggcuccuggggacaaucacugggccaccccaaugugaccaauuccuagaauuuucagcugauuuaauuauugagaggcgagaagggagugaugucuguuauccugggaaguucguaaaugaagaagcucugaggcagauucucagagaaucaggcggaauugacaaggaaacaaugggauucacauacagcggaauaagaacuaauggagcaaccagugcauguaggagaucaggaucuucauucuaugcagaaaugaaauggcuccugucaaacacagacaaugcugcuuucccgcagacgacuaaaucauacaaaaauacaaggaaagacccagcuuuaauaauaugggggauucaccauucuggaucaacuacagaacagaccaagcuauaugggaguggaaacaaacugauaacaguugggaguucuaauuaucaacagucuuuugugccgaguccaggagcgagaccacaaguuaauggccaaucuggaaggauugacuuucauuggcuaaugcuaaaccccaaugauacagucacuuucaguuucaauggggccuucauagcuccagaccgugcaagcuuccugagaggaaaaucuaugggaauucagaguggaguacagguugaugccaauugugaaggggauugcuaucacaauggagggacaauaauaaguaauuugcccuuucagaacauaaauagcagagcaguagggaaauguccgagauauguuaagcaagagagucugcugcuagcaacagggaugaagaauguuccugagauuccaaagggaagaggucuauuuggugcuauagcagguuuuauugaaaauggaugggaaggucuaguugaugggugguaugguuucaggcaucaaaaugcacagggagaggggacugcugcagauuacaaaagcacucagucggcaauugaucaaauaacagggaaauuaaaucggcuuauagaaaaaaccaaccaacaauuugaguuaauagacaaugaguucacugagguugaaaggcaaauuggcaauguaauaaauuggaccagagacuccaugacagaggugugguccuacaaugcugaacucuuaguagcaauggagaaccagcacacaauugaucuggcugauucagaaaugaauaaacuauacgaacgagugaggagacagcugagagagaaugcugaagaagauggcaccgguugcuuugaaauauuucacaagugugaugacgacuguauggccaguauuagaaauaacaccuaugaucacagcaaguacagggaagaggcaaugcaaaauagaauacaaauugauccagucaaacuaagcaguggcuacaaagaugugauacuuugguuuagcuucggggcaucauguuucauacuucuggccauugcaaugggccuugucuucauaugugugaaaaauggaaacaugcggugcacuauuuguauauaa

SEQ ID NO: 40700 - RNA, 1683 nt, Artificial Sequence
  hemagglutinin__InfluenzaA__AGQ80977
augaacacucaaauccuggcacucgcucuggcugcgaucauuccgacaaaugcagacaaaaucugccucggacaucaugcugugucaaacggaacuaaaguaaacacauuaacugaaagaggaguggaagucgucaaugcaacugaaacaguggaacgaacaagcauccccaggaucugcucaaaagggaaaagggcaguugaccucggucaauguggacuccuggggacaaucacugggccaccccaaugugaccaauuccuagaauuuucagcugauuuaauuauugagaggcgagaagggagugaugucuguuauccugggaaguucguaaaugaagaagcucugaggcagauucucagagaaucaggcggaauugacaaggaaacaaugggauucacauacagcggaauaagaacuaauggagcaaccagugcauguaggagaucaggaucuucauucuaugcagaaaugaaauggcuccugucaaacacagacaaugcugcuuucccgcagacgacuaaaucauacaaaaauacaaggaaagacccagcuuuaauaauaugggggguucaccauucuggaucaacuacagaacagaccaagcuauaugggaguggaaacaaacugauaacaguugggaguucuaauuaucaacagucuuuugugccgaguccaggagcgagaccacaaguuaauggccaaucuggaaggauugacuuucauuggcuaaugcuaaaccccaaugauacagucacuuucaguuucaauggggccuucauagcuccagaccgugcaagcuuccugagaggaaaaucuaugggaauucagaguggaguacagguugaugccaauugugaaggggauugcuaucacaauggagggacaauaauaaguaauuugcccuuucagaacauaaauagcagagcaguagggaaauguccgagauauguuaagcaagagagucugcugcuagcaacagggaugaagaauguuccugagauuccaaagggaagaggucuauuuggugcuauagcagguuuuauugaaaauggaugggaaggucuaguugaugggugguaugguuucaggcaucaaaaugcacagggagaggggacugcugcagauuacaaaagcacucagucggcaauugaucaaauaacagggaaauuaaaucggcuuauagaaaaaaccaaccaacaauuugaguuaauagacaaugaguucacugagguugaaaggcaaauuggcaauguaauaaauuggaccagagacuccaugacagaggugugguccuacaaugcugaacucuuaguagcaauggagaaccagcacacaauugaucuggcugauucagaaaugaauaaacuauacgaacgagugaggagacagcugagagagaaugcugaagaagauggcaccgguugcuuugaaauauuucacaagugugaugacgacuguauggccaguauuagaaauaacaccuaugaucacagcaaguacagggaagaggcaaugcaaaauagaauacaaauugauccagucaaacuaagcaguggcuacaaagaugugauacuuugguuuagcuucggggcaucauguuucauacuucuggccauugcaaugggccuugucuucauaugugugaaaaguggaaacaugcggugcacuauuuguauauaa

SEQ ID NO: 40701 - RNA, 1683 nt, Artificial Sequence
  hemagglutinin__InfluenzaA__AGQ80978
augaacacucaaauccugguauucgcucugguugcgaucauuccaacaaaugcagacaaaaucugccucggacaucaugcugugucaaacggaacuaaaguaaacacauuaacugaaagaggaguggaagucguuaaugcaacugaaacaguggaacgaacaagcauccccaggaucugcucaaaagggaaaagggcaguugaccucggucaauguggacuccuggggacaaucacugggccaccccaaugugaccaauuccuagaauuuucagcugauuuaauuauugagaggcgagaagggagugaugucuguuauccugggaaguucguaaaugaagaagcucugaggcagauucucagggaaucaggcggaauugacaaggaaacaaugggauucacauacagcggaauaagaacuaauggagcaaccagugcauguaggagaucaggaucuucauucuaugcagaaaugaaauggcuccugucaaacacagacaaugcugcuuucccgcagacgacuaaaucauacaaaaauacaaggaaagacccagcuuuaauaauaugggggauucaccauucuggaucaauuacagaacagaccaagcuauaugggaguggaaacaaacugauaacaguugggaguucuaauuaucaacagucuuuugugccgaguccaggagcgagaccacaaguuaauggccaaucuggaaggauugacuuucauuggcuaaugcuaaaccccaaugauacagucacuuucaguuucaauggggcauucauagcuccagaccgugcaagcuuccugagaggaaaaucuaugggaauucagaguggaguacagguugaugccaauugugaaggggauugcuaucacaauggagggacaauaauaaguaauuugcccuuucagaacauaaauagcagagcaguagggaaauguccgagauauguuaagcaagagagucugcugcuagcaacagggaugaagaauguuccugagauuccaaagggaagaggucuauuuggugcuauagcagguuuuauugaaaauggaugggaaggucuaguugaugggugguaugguuucaggcaucaaaaugcacagggagaggggacugcugcagauuacaaaagcacucagucggcaauugaucaaauaacagggaaauuaaaucggcuuauagaaaaaaccaaccaacaauuugaguuaauagacaaugaguucacugagguugaaaggcaaauuggcaauguaauaaauuggaccagagacuccaugacagaggugugguccuacaaugcugaacucuuaguagcaauggagaaccagcacacaauugaucuggcugauucagaaaugaauaaacuauacgaacgagugaggagacagcugagagagaaugcugaagaagauggcaccgguugcuuugaaauauuucacaagugugaugacgacuguauggccaguauuagaaauaacaccuaugaucacagcaaguacagggaagaggcaaugcaaaauagaauacaaauugauccagucaaacuaagcaguggcuacaaagaugugauacuuugguuuagcuucggggcaucauguuucauacuucuggccauugcaaugggccuugucuucauaugugugaaaaauggaaacaugcggugcacuauuuguauauaa

SEQ ID NO: 40702 - RNA, 1683 nt, Artificial Sequence
  hemagglutinin__InfluenzaA__AGQ80979
augaacacucaaauccugguauucgcucugguugcgaucauuccgacaaaugcagacaaaaucugccucggacaucaugcugugucaaacggaacuaaaguaaacacauuaacugaaagaggaguggaagucguuaaugcaacugaaacaguggaacgaacaagcauccccaggaucugcucaaaagggaaaagggcaguugaccucggucaauguggacuccuggguacaaucacugggccaccccaaugugaccaauuccuagaauuuucggccgauuugauuauugagaggcgagaaggaagugaugucuguuauccugggaaauuuguaaaugaagaagcuuugaggcaaauucucagggaaucaggcggaauugacaaggaaacaaugggauucacauacagcggaauaagaacuaauggagcaaccagugcauguaggagaucaggaucuucauucuaugcagaaaugaaauggcuccugucaaacacagauaaugcugcuuucccgcagacgacuaaaucauacaaaaauacaaggaaagacccagcuuuaauaauaugggggauucaccauucuggaucaacuacagaacagaccaagcuauaugggaguggaaacaaacugauuacaguugggaguucuaauuaucaacagucuuuugugccgaguccaggagcgagaccacaaguuaauggccaaucuggaaggauugacuuucauuggcugaugcuaaaccccaaugauacagucacuuucaguuucaauggggccuucauagcuccagaccgugcaagcuuccugagaggaaaaucuauaggaauucagaguggaguacagguugaugccaauugugaaggggauugcuaucacaauggagggacaauaauaaguaauuugcccuuucagaacauaaauagcagggcaguagggaaauguccgagauauguuaagcaagagagucugcugcuagcaacagggaugaagaauguucccgagauuccaaagggaagaggucuauuuggugcuauagcagguuucauugaaaauggaugggaagguuuaauugaugggugguaugguuucaggcaucaaaaugcacagggagaggggacugcugcagauuacaaaagcacucagucggcaauugaucaaauaacagggaaauuaaaccggcuuauagaaaaaaccaaccaacaauuugaguuaauagacaaugaguucacugagguugaaaggcaaauugguaauguaauaaauuggaccagagacuccaugacagaggugugguccuacaaugcugaacucuuaguagcaauggagaaccagcacacaauugaucuggcugauucagaaaugaauaaacuauacgaacgagugaggagacagcugagagagaaugcugaagaagauggcacugguugcuuugaaauauuucacaagugugaugaugacuguauggccaguauuagaaauaacaccuaugaucacagcaaguacagggaagaggcaaugcaaaauagaauacagauugauccagucaaacuaagcaguggcuacaaagaugugauacuuugguuuagcuucggggcaucauguuucauacuucuggccauugcaaugggccuugucuucauaugugugaagaauggaaacaugcggugcacuauuuguauauaa

SEQ ID NO: 40703 - RNA, 1683 nt, Artificial Sequence
  hemagglutinin__InfluenzaA__AGQ80980
augaacacucaaauccugguauucgcucugguugcgaucauuccgacaaaugcagacaaaaucugccucggacaucaugcugugucaaacggaacuaaaguaaacacauuaacugaaagaggaguggaagucguuaaugcaacugaaacaguggaacgaacaagcauccccaggaucugcucaaaagggaaaagggcaguugaccucggucaauguggacuccuggggacaaucacugggccaccccaaugugaccaauuccuagaauuuucagcugauuuaauuauugagaggcgagaagggagugaugucuguuauccugggaaguucguaaaugaagaagcucugaggcagauucucagggaaucagguggaauugacaaggaaacaaugggauucacauacagcggaauaagaacuaauggagcaaccagugcauguaggagaucaggaucuucauucuaugcagaaaugaaauggcuccugucaaacacagacaaugcugcuuucccgcagacgacuaaaucauacaaaaauacaaggaaagacccagcuuuaauaauaugggggauucaccauucuggaucaacuacagaacagaccaaacuauaugggaguggaaacaaacugauaacaguugggaguucuaauuaucaacagucuuuugugccgaguccaggagcgagaccacaaguuaauggucaaucuggaaggauugacuuucauuggcuaaugcuaaaccccaaugauacagucacuuucaguuucaauggggccuucauagcuccagaccgugcaagcuuccugagaggaaaaucuaugggaauucagaguggaguacagguugaugccaauugugaaggggacugcuaucacaauggagggacaauaauaaguaauuugcccuuucagaacauaaauagcagagcaguagggaaauguccgagauauguuaaacaggagagucugcugcuagcaacagggaugaagaauguuccugagauuccaaagggaagaggucuauuuggugcuauagcagguuuuauugaaaauggaugggaaggucuaguugauggaugguaugguuucaggcaucaaaaugcacagggagaggggacugcugcagauuacaaaagcacucagucggcaauugaucaaauaacagggaaauuaaaucggcuuauagaaaaaaccaaccaacaauuugaguuaauagacaaugaguucacugagguugaaaggcaaauuggcaauguaauaaauuggaccagagacuccaugacagaagugugguccuacaaugcugaacucuuaguagcaauggagaaccagcacacaauugaucuggcugauucagaaaugaauaaacuauacgaacgagugaggagacagcugagagagaaugcugaagaagauggcaccgguugcuuugaaauauuucacaagugugaugacgacuguauggccaguauuagaaauaacaccuaugaucacagcaaguacagggaagaggcaaugcaaaauagaauacaaauugauccagucaaacuaagcaguggcuacaaagaugugauacuuugguuuagcuucggggcaucauguuucauacuucuggccauugcaaugggccuugucuucauaugugugaaaaauggaaacaugcggugcacuauuuguauauaa

SEQ ID NO: 40704 - RNA, 1683 nt, Artificial Sequence
  hemagglutinin__InfluenzaA__AGQ80981
augaacacucaaauccugguauucgcucugguugcgaucauuccgacaaaugcagacaaaaucugccucggacaucaugcugugucaaacggaacuaaaguaaacacauuaacugaaagaggaguggaaguugucaaugcaacugaaacaguggaacgaacaagcauccccaggaucugcucaaaagggaaaagggcaguugaccuuggucaauguggacuccuggguacaaucacugggccaccccaaugugaucaauuccuagaauuuucggccgauuugauuauugagaggcgagaaggaagugaugucuguuauccugggaaguuuguaaaugaagaagcuuuaagacaaauucucagggaaucaggcggaauugacaaggaaacaaugggauucacauacagcggaauaagaacuaauggagcaaccagugcguguaggagaucaggaucuucauucuaugcagaaaugaaauggcuccugucaaacacagauaaugcugcuuucccgcagacgaccaaaucauacaaaaauacaaggaaagacccagcuuuaauaauaugggggauucaccauucuggaucaacuacagaacaaaccaagcuauaugggaguggaaacaaacugauaacaguugggaguucuaauuaucaacagucuuuugugccgaguccaggagcgagaccacaaguuaauggccaaucuggaaggauugacuuucauuggcugaugcuaaaccccaaugauacagucacuuucaguuucaauggggccuucauagcuccagaccgugcaagcuuccugagaggaaaaucuaugggaauucagaguggaguacagguugaugccaauugugaaggggauugcuaucacaauggagggacaauaauaaguaauuugcccuuucagaacauaaauagcagggcaguagggaaauguccgagauauguuaagcaagagagccugcugcuagcaacagggaugaagaauguucccgagauuccaaagggaagaggucuauuuggugcuauagcagguuucauugaaaauggaugggaaggucuaauugaugggugguaugguuucaggcaucaaaaugcacagggagaggggacugcugcagauuacaaaagcacucagucagcaauugaucaaauaacagggaaauuaaaccggcuuauagaaaaaaccaaccaacaauuugaguuaauagacaaugaguucacugagguugaaaggcaaauugguaauguaauaaauuggaccagagacuccaugacagaggugugguccuacaaugcugaacucuuaguagcaauggagaaccagcauacaauugaucuggcugauucagaaaugaauaaacuauacgaacgagugaggagacagcugagagagaaugcugaagaagauggcaccgguugcuuugaaauauuucacaagugugaugaugacuguauggccaguauuagaaauaacaccuaugaucacagcaaguacagggaagaggcaaugcaaaauagaauacagauugauccagucaaacuaagcaguggcuacaaagaugugauacuuugguuuagcuucggggcaucauguuucauacuucuggccauugcaaugggccuugucuucauaugugugaagaauggaaacaugcggugcacuauuuguauauaa

SEQ ID NO: 40705 - RNA, 1683 nt, Artificial Sequence; identical to SEQ ID NO: 40704
  hemagglutinin__InfluenzaA__AGQ80982

SEQ ID NO: 40706 - RNA, 1683 nt, Artificial Sequence; identical to SEQ ID NO: 40704
  hemagglutinin__InfluenzaA__AGQ80983

SEQ ID NO: 40707 - RNA, 1683 nt, Artificial Sequence; identical to SEQ ID NO: 40704
  hemagglutinin__InfluenzaA__AGQ80984

SEQ ID NO: 40708 - RNA, 1683 nt, Artificial Sequence
  hemagglutinin__InfluenzaA__AGQ80985
augaacacucaaauccugguauucgcucugguugcgaucauuccgacaaaugcagacaaaaucugccucggacaucaugcugugucaaacggaacuaaaguaaacacauuaacugaaagaggaguggaaguugucaaugcaacugaaacaguggaacgaacaagcauccccaggaucugcucaaaagggaaaagggcaguugaccuuggucaauguggacuccuggguacaaucacugggccaccccaaugugaucaauuccuagaauuuucggccgauuugauuauugagaggcgagaaggaagugaugucuguuauccugggaaguuuguaaaugaagaagcuuuaagacaaauucucagggaaucaggcggaauugacaaggaaacaaugggauucacauacagcggaauaagaacuaauggagcaaccagugcguguaggagaucaggaucuucauucuaugcagaaaugaaauggcuccugucaaacacagauaaugcugcuuucccgcagacgaccaaaucauacaaaaauacaaggaaagacccagcuuuaauaauaugggggauucaccauucuggaucaacuacagaacaaaccaagcuauaugggaguggaaacaaacugauaacaguugggaguucuaauuaucaacagucuuuugugccgaguccaggagcgagaccacaaguuaauggccaaucuggaaggauugacuuucauuggcugaugcuaaaccccaaugauacagucacuuucaguuucaauggggccuucauagcuccagaccgugcaagcuuccugagaggaaaaucuaugggaauucagaguggaguacagguugaugccaauugugaaggggauugcuaucacaauggagggacaauaauaaguaauuugcccuuucagaacauaaauagcagggcaguagggaaauguccgagauauguuaagcaagagagccugcugcuagcaacagggaugaagaauguucccgagauuccaaagggaagaggucuauuuggugcuauagcagguuucauugaaaauggaugggaaggucuaauugaugggugguaugguuucaggcaucaaaaugcacagggagaggggacugcugcagauuacaaaagcacucagucagcaauugaucaaauaacagggaaauuaaaccggcuuauagaaaaaaccaaccaacaauuugaguuaauagacaaugaguucacugagguugaaaggcaaauugguaauguaauaaauuggaccagagacuccaugacagaggugugguccuacaaugcugaacucuuaguagcaauggagaaccagcauacaauugaucuggcugauucagaaaugaauaaacuauacgaacgagugaggagacagcugagagagaaugcugaagaagauggcaccgguugcuuugaaauauuucacaagugugaugaugacuguauggccaguauuagaaauaacaccuaugaucacagcaaguacagggaagaagcaaugcaaaauagaauacagauugauccagucaaacuaagcaguggcuacaaagaugugauacuuugguuuagcuucggggcaucauguuucauacuucuggccauugcaaugggccuugucuucauaugugugaagaauggaaacaugcggugcacuauuuguauauaa

SEQ ID NO: 40709 - RNA, 1683 nt, Artificial Sequence; identical to SEQ ID NO: 40684
  hemagglutinin__InfluenzaA__AGQ80986

SEQ ID NO: 40710 - RNA, 1683 nt, Artificial Sequence
  hemagglutinin__InfluenzaA__AGQ80987
augaacacucaaauccugguauucgcucugguugcgaucauuccgacaaaugcagacaaaaucugccucggacaucaugcugugucaaacggaacuaaaguaaacacauuaacugaaagaggaguggaagucguuaaugcaacugaaacaguggaacgaacaagcauccccaggaucugcucaaaagggaaaagggcaguugaccucggucaauguggacuccuggguacaaucacugggccaccccaaugugaccaauuccuagaauuuucggccgacuugauuauugagaggcgagaaggaagugaugucuguuauccugggaaauuuguaaaugaagaagcuuugaggcaaauucucagggaaucaggcggaauugacaaggaaacaaugggauucacauacagcggaauaagaacuaauggagcaaccagugcauguaggagaucaggaucuucauucuaugcagaaaugaaauggcuccugucaaacacagauaaugcugcuuucccgcagacgacuaaaucauacaaaaauacaaggaaagacccagcuuuaauaauaugggggauucaccauucuggaucaacuacagaacagaccaagcuauaugggaguggaaacaaacugauaacaguugggaguucuaauuaucaacagucuuuugugccgaguccaggagcgagaccacaaguuaauggccaaucuggaaggauugacuuucauuggcugaugcuaaaccccaaugauacagucacuuucaguuucaauggggccuucauagcuccagaccgugcaagcuuccugagaggaaaaucuaugggaauucagaguggaguacagguugaugccaauugugaaggggauugcuaucacaauggagggacaauaauaaguaauuugccauuucagaacauaaauagcagggcaguagggaaauguccgagauauguuaagcaagagagucugcugcuagcaacagggaugaagaauguucccgagauuccaaagggaagaggucuauuuggugcuauagcagguuucauugaaaauggaugggaagguuuaauugaugggugguaugguuucaggcaucaaaaugcacagggagaggggacugcugcagauuacaaaagcacucagucggcaauugaucaaauaacagggaaauuaaaccggcuuauagaaaaaaccaaccaacaauuugaguuaauagacaaugaguucacugagguugaaaggcaaauugguaauguaauaaauuggaccagagacuccaugacagaggugugguccuacaaugcugaacucuuaguagcaauggagaaccagcacacaauugaucuggcugauucagaaaugaauaaacuauacgaacgagugaggagacagcugagagagaaugcugaagaagauggcaccgguugcuuugaaauauuucacaagugugaugaugacuguauggccaguauuagaaauaacaccuaugaucacagcaaguacagggaagaggcaaugcaaaauagaauacagauugauccagucaaacuaagcaguggcuacaaagaugugauacuuugguuuagcuucggggcaucauguuucauacuucuggccauugcaaugggccuugucuucauaugugugaagaauggaaacaugcggugcacuauuuguauauaa

SEQ ID NO: 40711 - RNA, 1683 nt, Artificial Sequence; identical to SEQ ID NO: 40684
  hemagglutinin__InfluenzaA__AGQ80988

SEQ ID NO: 40712 - RNA, 1683 nt, Artificial Sequence
  hemagglutinin__InfluenzaA__AGQ80990
augaacacucaaauccugguauucgcucugguugcgaucauuccgacaaaugcagacaaaaucugccucggacaucaugcugugucaaacggaacuaaaguaaacacauuaacugaaagaggaguggaaguugucaaugcaacugaaacaguggaacgaacaagcauccccaagaucugcucaaaagggaaaagggcaguugaccuuggucaauguggacuccuggguacaaucacugggccaccccaaugugaucaauuccuagaauuuucggccgauuugauuauugagaggcgagaaggaagugaugucuguuauccugggaaguuuguaaaugaagaagcuuuaagacaaauucucagggaaucaggcggaauugacaaggaaacaaugggauucacauacagcggaauaagaacuaauggagcaaccagugcguguaggagaucaggaucuucauucuaugcagaaaugaaauggcuccugucaaacacagauaaugcugcuuucccgcagacgaccaaaucauacaaaaauacaaggaaagacccagcuuuaauaauaugggggauucaccauucuggaucaacuacagaacaaaccaagcuauaugggaguggaaacaaacugauaacaguugggaguucuaauuaucaacagucuuuugugccgaguccaggagcgagaccacaaguuaauggccaaucuggaaggauugacuuucauuggcugaugcuaaaccccaaugauacagucacuuucaguuucaauggggccuucauagcuccagaccgugcaagcuuccugagaggaaaaucuaugggaauucagaguggaguacagguugaugccaauugugaaggggauugcuaucacaauggagggacaauaauaaguaauuugcccuuucagaacauaaauagcagggcaguagggaaauguccgagauauguuaagcaagagagccugcugcuagcaacagggaugaagaauguucccgagauuccaaagggaagaggucuauuuggugcuauagcagguuucauugaaaauggaugggaaggucuaauugaugggugguaugguuucaggcaucaaaaugcacagggagaggggacugcugcagauuacaaaagcacucagucagcaauugaucaaauaacagggaaauuaaaccggcuuauagaaaaaaccaaccaacaauuugaguuaauagacaaugaguucacugagguugaaaggcaaauugguaauguaauaaauuggaccagagacuccaugacagaggugugguccuacaaugcugaacucuuaguagcaauggagaaccagcauacaauugaucuggcugauucagaaaugaauaaacuauacgaacgagugaggagacagcugagagagaaugcugaagaagauggcaccgguugcuuugaaauauuucacaagugugaugaugacuguauggccaguauuagaaauaacaccuaugaucacagcaaguacagggaagaggcaaugcaaaauagaauacagauugauccagucaaacuaagcaguggcuacaaagaugugauacuuugguuuagcuucggggcaucauguuucauacuucuggccauugcaaugggccuugucuucauaugugugaagaauggaaacaugcggugcacuauuuguauauaa

SEQ ID NO: 40713 - RNA, 1683 nt, Artificial Sequence
  hemagglutinin__InfluenzaA__AGQ80991
augaacacucaaauccugguauucgcucugguugcgaucauuccgacaaaugcagacaaaaucugccucggacaucaugcugugucaaacggaacuaaaguaaacacauuaacugaaagaggaguggaagucguuaaugcaacugaaacaguggaacgaacaagcauccccaggaucugcucaaaagggaaaaagacaguugaccucggucaauguggacuccuggguacaaucacugggccaccccaaugugaccaauuccuagaauuuucagccgauuugauuauugagaggcgagaaggaagugaugucuguuauccugggaaguuuguaaaugaagaagcuuugaggcaaauucucagggaaucaggcggaauugacaaggaaacaaugggauucacauacagcggaauaagaacuaauggagcaaccagugcauguaggagaucaggaucuucauucuaugcagaaaugaaauggcuccugucaaacacagauaaugcugcuuucccgcagacgacuaaaucauacaaaaauacaaggaaagacccagcuuuaauaauaugggggauucaccauucuggaucaacuacagaacagaccaagcuauaugggaguggaaacaaacugauaacaguugggaguucuaauuaucaacagucuuuugugccgaguccaggagcgagaccacaaguuaauggccaaucuggaaggauugacuuucauuggcugaugcuaaaccccaaugauacagucacuuucaguuucaauggggccuucauagcuccagaccgugcaagcuuccugagaggaaaaucuaugggaauucagaguggaguacagguugaugccaauugugaaggggauugcuaucacaauggagggacaauaauaaguaauuugcccuuucagaacauaaauagcagggcaguagggaaauguccgagauauguuaagcaagagagucugcugcuagcaacagggaugaagaauguucccgagauuccaaagggaagaggucuauuuggugcuauagcagguuucauugaaaauggaugggaaggucuaauugaugggugguaugguuucaggcaucaaaaugcacagggagaggggacugcugcagauuacaaaagcacucagucggcaauugaucaaauaacagggaaauuaaaccggcuuauagaaaaaaccaaccaacaauuugaguuaauagacaaugaguucacugagguugaaaggcaaauugguaauguaauaaauuggaccagagacuccaugacagaggugugguccuacaaugcugaacucuuaguagcaauggagaaccagcacacaauugaucuggcugauucagaaaugaauaaacuauacgaacgagugaggagacagcugagagagaaugcugaagaagauggcaccgguugcuuugaaauauuucacaagugugaugaugacuguauggccaguauuagaaauaacaccuaugaucacagcaaguacagggaagaggcaaugcaaaauagaauacagauugauccagucaaacuaagcaguggcuacaaagaugugauacuuugguuuagcuucggggcaucauguuucauacuucuggccauugcaaugggccuugucuucauaugugugaagaauggaaacaugcggugcacuauuuguauauaa

SEQ ID NO: 40714 - RNA, 1683 nt, Artificial Sequence
  hemagglutinin__InfluenzaA__AGQ80992
augaacacucaaauccugguauucgcucugguggcgaucauuccgacgaaugcagacaagaucugccuugggcaccaugccgugucaaacgggacuaaaguaaacacauuaacugaaagaggaguggaagucguuaaugcaacugaaacaguugaacgaacaaauguccccaggaucugcucaaaagggaaaaggacaguugaccucggucaauguggacuucugggaacaauaacugggccaccccaaugugaccaauuccuagaauuuucagccgauuuaauuauugagaggcgagaaggaagugaugucuguuauccugggaaauucaugaaugaagaagcucugaggcaaauucucagggagucagguggaauugacaaggagacgaugggguucacauacagcggaauaagaacuaauggagcaaccagugcauguagaagaucaggaucuucauucuaugcagaaaugaaauggcuccugucaaacacagacaaugcugcuuucccgcagaugacuaagucauacaaaaacacaaggaaagacccagcucugauaauaugggggauccaccauuccggaucaaccacagaacagaccaagcuauacgggaguggaaacaaauugauaacaguugggaguucuaauuaccaacaguccuuuguaccgaguccgggagcgaggccacaagugaauggccaaucuggaaggauugacuuucauuggcugaugcugaaccccaaugacacaguuacuuucaguuucaauggggccuucauagcuccagaccgugcaugcuuucuaagagggaagucuaugggaauucagaguggaguacagguugaugccaguugugaaggagauugcuaucauaguggagggacaauaauaaguaauuugcccuuucagaacauaaauagcagggcaguggggaaguguccgagguauguuaagcaggagagucugaugcuggcaacaggaaugaagaauguuccugaaaucccaaagggaagaggccuguuuggugcuauagcgggcuucauugaaaauggaugggaaggucugauugacggaugguauggcuucaggcaucaaaaugcacaaggggagggaacugcugcagauuacaagagcacccaaucagcaauugaucaaauaacagggaaauuaaaccggcuuauagaaaaaacuaaccaacaauuugaguuaauagacaaugaauucacugagguugaaaagcaaauuggcaaugugauaaauuggaccagagauuccaugacagaaguguggucauauaacgcugaacucuugguagcaauggagaaucagcacacaaucgaucuggccgacucagaaaugaacaaacuauacgaacgggugaagaggcaacugagagagaaugcugaagaagauggcacugguuguuuugaaauauuucacaagugugaugacgacuguauggccaguauuagaaacaacaccuaugaucacagcaaguacagggaagaggcaaugcaaaauagaauacagauugacccggucaaacuaagcagcggcuacaaagaugugauacuuugguuuagcuucggggcaucauguuucauacuucuggccauugcaaugggccuugucuucauaugugugaagaauggaaacaugcggugcacuauuuguauauaa

SEQ ID NO: 40715 - RNA, 1683 nt, Artificial Sequence; identical to SEQ ID NO: 40684
  hemagglutinin__InfluenzaA__AGQ80993

SEQ ID NO: 40716 - RNA, 1683 nt, Artificial Sequence; identical to SEQ ID NO: 40691
  hemagglutinin__InfluenzaA__AGQ80994

SEQ ID NO: 40717 - RNA, 1683 nt, Artificial Sequence
  hemagglutinin__InfluenzaA__AGQ80995
augaacacucaaauccugguauucgcucugauugcgaucauuccaacaaaugcagacaaaaucugccuuggacaucaugcugugucaaacggaacuaaaguaaacacauuaacugaaagaggaguggaagucguuaaugcaacugaaacaguggaacggacaaacauccccaggaucugcucaaaggggaaaaggacaguugaccucggucaauguggacuccuggggacaaucacuggaccaccucaaugugaccaauuccuagaauuuucagccgauuuaauuauugagaggcgagaaggaagugaugucuguuauccugggaaauucgugaaugaagaagcucugaggcaaauucucagggaaucaggcggaauugacaaggaagcaaugggauucacauacagcggaauaagaacuaauggagcaaccagugcauguaggagaucagggucuucauucuaugcagaaaugaaauggcuccugucaaacacagauaaugcugcuuucccgcagaugacuaagucauauaaaaauacaaggaaagacccagcucuaauaauaugggggauccaucauuccggaucaacugcagagcaaaccaagcuauaugggaguggaaacaaacuggugacaguugggaguucuaauuaucaacaaucuuuugugccgaguccaggagcgagaccacaaguuaauggucaaucuggaaggauugacuuucauuggcuaaugcugaaucccaaugauacugucaccuucaguuucaauggggcuuucauagcuccagaccgugcaagcuuccugagagggaaaucuaugggaauucagaguggaguacagguugaugccgauugugaaggggauugcuaucauaguggagggacaauaauaagcaauuugccauuucagaacauagauagcagggcaguaggaaaauguccgagauauguuaagcaaaggagucugcugcuagcaacagggaugaagaauguuccugagauuccaaagggaagaggccuauuuggugcuauagcggguuucauugaaaauggaugggaaggccuaauugaugggugguaugguuucaggcaccagaaugcacagggagagggaacugcugcagauuacaaaagcacucaaucggcaauugaucaaauaacaggaaaauuaaaccggcuuauagaaaaaaccaaccaacaauuugaguugauagacaaugaguucacugagguagagaagcaaaucgguaaugugauaaauuggaccagagacucuauaacagaaguguggucauacaaugcugaacucuugguagcaauggagaaccagcauacgauugaucuggcugauucagaaaugaauaaacuguacgaacgagugaaaagacagcugagagagaaugcugaagaagauggcacugguugcuuugaaauauuucacaagugugaugaugacuguauggccaguauuagaaauaacaccuaugaucacagcaaauacagggaagaggcaaugcaaaauagaauacagauugacccagucaaacuaagcaguggauacaaagaugugauacuuugguuuagcuucggggcaucauguuucauacuucuagccauugcaaugggccuugucuucauaugugugaagaauggaaacaugcggugcacuauuuguauauaa

SEQ ID NO: 40718 - RNA, 1683 nt, Artificial Sequence; identical to SEQ ID NO: 40693
  hemagglutinin__InfluenzaA__AGQ80996

SEQ ID NO: 40719 - RNA, 1683 nt, Artificial Sequence
  hemagglutinin__InfluenzaA__AGQ80997
augaacacucaaauccugguauucgcucugguggcgaucauuccgacaaaugcagacaaaaucugccucggacaucaugcugugucaaacggaacuaaaguaaacacauuaacugaaagaggaguggaagucguuaaugcaacugaaacgguggaacgaacaaacauccccaggaucugcucaaaagggaaaaggacaguugaccucggucaauguggacuccugggaacaaucacugggccaccccaaugugaccaauuccuagaauuuucagccgauuuaauuauugagaggcgagaaggaagugaugucuguuauccugggaaauucgugaaugaagaagcucugaggcaaauucucagggagucaggcggaauugacaaggaaacaaugggauucacauacagcggaauaagaacugauggagcaaccagugcauguaggagaucaggaucuucauucuaugcagagaugaaauggcuccugucaaacacagauaaugcugcuuucccgcagaugacuaagucauacaaaaacacaaggaaagacccagcucugauaauaugggggauccaccauuccggaucaacuacagaacagaccaagcuauaugggaguggaaacaaacugauaacaguuggaaguucuaauuaccaacagucuuuuguaccgagcccaggagcgagaccacaaguuaauggccaaucuggaagaauugacuuucauuggcugaugcuaaaccccaaugauacagucacuuucaguuucaauggggccuucauagcuccagaccgugcaagcuuccugagagggaaaucuaugggaauucagaguggaguacagguugaugccaauugugaaggggauugcuaucauaguggagggacaauaauaaguaauuugcccuuucagaacauaaauagcagggcaguagggaaauguccgagauauguuaagcaagagagucuacugcuagcaacagggaugaagaauguuccugagauuccaaagggaagaggccuauuuggugcuauagcggguuucauugaaaauggaugggaaggucuaauugaugggugguaugguuucaggcaucaaaauucacagggagagggaaccgcugcagauuacaaaagcacucaaucggcaauugaucaaauaacagggaaauugaaccggcuuauagaaaaaaccaaccaacaauuugaguuaauagacaaugaauucacugagguugaaaagcaaauugguaaugugauaaauuggaccagagacuccaugacagaagugugguccuacaacgcugaacucuugguagcaauggagaaccagcacacaauugaucuggcugacucagaaaugaauaaacuauacgaacgagugaagagacaacugagagagaaugcugaagaagauggcacugguugcuuugaaauauuucacaagugugaugacgacuguauggccaguauuagaaauaacaccuaugaucacagcaaguacagggaagaggcaaugcaaaauagaauacagauugacccagucaaacuaagcagcggcuacaaagaugugauacuuugguuuagcuucggggcaucauguuucauacuucuggccauugcaaugggccuugucuucauaugugugaagaauggaaacaugcggugcacuauuuguauauaa

SEQ ID NO: 40720 - RNA, 1683 nt, Artificial Sequence
  hemagglutinin__InfluenzaA__AGQ81000
augaacacucaaauccugguauucgcucugguugcgaucauuccgacaaaugcagacaagaucugccucggacaucaugcugugucaaacggaacuaaaguaaacacauuaacugaaagaggaguggaagucguuaaugcaacugaaacgguggaacgaacaaacauccccaggaucugcucaaaagggaaaaggacaguugaccucggucaauguggacuccuggggacaaucacugggccaccccaaugugaccaauuccuagaauuuucagccgauuuaauuauugagaggcgagaaggaagugaugucuguuauccugggaaguucgugaaugaagaagcucugaggcaaauucucagggaaucaggaggaauuggcaaagaaacaaugggauucacauacagcggaauaagaacuaauggagcaaccagugcauguaggagaucaggaucuucauucuaugcagagaugaaauggcuccugucaaacacagauaaugcugcuuucccgcagaugacuaagucauacaaaaauacaaggaaagacccagcucuaauaauaugggggauccaccauucuggaucaacuacagaacagaccaagcuauaugggaguggaaacaaacugauaacaguugggaguucuaauuaucaaaagucuuuugugccgagcccaggagcgagaccacaaguuaauggacaaucuggaaggauugacuuucauuggcugaugcuaaaccccaaugauacagucacuuucagcuucaauggggccuucauagcuccagaccgugcaagcuuccugagaggaaaaucuaugggaauucagaguggaguacagguugaugcuaauugugaaggggauugcuaucacaauggaggaacaauaauaaguaauuugcccuuucagaacauaaauagcagggcaguagggaaauguccgagauauguuaaacaagagagucugcugcuagcaacagggaugaagaauguuccugagauuccaaagggaagaggucuauuuggugcuauagcggguuucauugaaaauggaugggaaggucuaauugaugggugguaugguuucaggcaucaaaaugcacagggagaggggacugcugcagauuacaaaagcacucaaucggcaauugaucaaauaacagggaaauuaaaccggcuuauagaaaaaaccaaccaacaauuugaguuaauagacaaugaguucacugagguugaaaagcaaauugguaaugugauaaauuggaccagagacuccaugacagaagugugguccuacaaugcugaacucuugguagcaauggagaaccagcacacaauugaucuggcugacucagaaaugaauaaacuauacgaacgagugaagagacagcugagagagaaugcugaagaagauggcacugguugcuuugaaauauuucacaagugugaugaugacuguauggccaguauuagaaauaacaccuaugaucacagcaaguacagggaagaggcaaugcaaaauagaauacagauugacccagucaaacuaagcaguggcuacaaagaugugauacuuugguuuagcuucggggcaucauguuucauacuucuggccauugcaaugggccuugucuucauaugugugaagaauggaaacaugcggugcacuauuuguauauaa

SEQ ID NO: 40721 - RNA, 1683 nt, Artificial Sequence
  hemagglutinin__InfluenzaA__AGQ81001
augaacacucaaauccugguauucgcucugguugcgaucauuccgacaaaugcagacaagaucugccucggacaucaugcugugucaaacggaaccaaaguaaacacauuaacugaaagaggaguggaagucguuaaugcaacugaaacgguggaacgaacaaacauccccaggaucugcucaaaagggaaaaggacaguugaccucggucaauguggacuccuggggacaaucacugggccaccccaaugugaccaauuccuagaauuuucagccgauuuaauuauugagaggcgagaaggaagugaugucuguuauccugggaaguucgugaaugaagaagcucugaggcaaauucucagagaaucaggcggaauugacaaggaaacaaugggauucacauacagcggaauaagaacuaauggagcaaccagugcauguaggagaucaggaucuucauucuaugcagaaaugaaauggcuccugucaaacacagauaaugcugcuuucccgcagaugacuaagucauacaaaaauacaaggaaagacccagcucuaauaauaugggggauccaccauucuggaucaacuacagaacagaccaagcuauaugggaguggaaacaaacugauaacaguugggacuucuaauuaucaacagucuuuugugccgagcccaggagcgagaccacaaguuaauggccaaucuggaaggauugacuuucauuggcugaugcuaaaucccaaugauacagucacuuucaguuucaauggggccuucauagcuccagaccgugcaagcuuccugagaggaaaaucuaugggaauucagaguggaguacagguugaugccaauugugaaggggauugcuaucacaauggagggacaauaauaaguaauuugcccuuucagaacauaaauagcagggcaguagggaaauguccgagauauguuaagcaagagagucugcugcuagcaacagggaugaagaauguuccugagauuccaaagggaagaggucuauuuggugcuauagcggguuucauugaaaauggaugggaaggucuaauugaugggugguaugguuucaggcaucaaaaugcacagggagaggggacugcugcagauuacaaaagcacucaaucggcaauugaucaaauaacagggaaauuaaaccggcuuauagaaaaaaccaaccaacaauuugaguuaauagacaaugaauucacugagauugaaaagcaaauugguaaugugauaaauuggaccagagacuccaugacagaagugugguccuacaaugcugaacucuugguagcaauggagaaccagcacacaauugaucuggcugacucagaaaugaauaaacuauacgaacgagugaagagacagcugagagagaaugcugaagaagauggcacugguuguuuugaaauauuucacaagugugaugaugacuguauggccaguauuagaaacaacaccuaugaucacagcaaguacagggaagaggcaaugcaaaauagaauacagauugauccagucaaacuuagcaguggcuacaaagaugugauacuuugguuuagcuucggggcaucauguuucauacuucuggccauugcaaugggccuugucuucauaugugugaagaauggaaacaugcggugcacuauuuguauauaa

SEQ ID NO: 40722 - RNA, 1683 nt, Artificial Sequence
  hemagglutinin__InfluenzaA__AGQ81002
augaacacucaaauccugguauucgcucugguugcgaucauuccgacaaaugcagacaaaaucugccucggacaucaugcugugucaaacggaacuaaaguaaacacauuaacugaaagaggaguggaagucguuaaugcaacugaaacaguggaacgaacaagcauccccaggaucugcucaaaagggaaaagggcaguugaccucggucaauguggacuccuggggacaaucacugggccaccccaaugugaccaauuccuagaauuuucagcugauuuaauuauugagaggcgagaagggagugaugucuguuauccugggaaguucgugaaugaagaagcucugaggcagauccucagggaaucaggcggaauugacaaggaaacaaugggauucacauacagcgggauaagaacuaauggagcaaccagugcauguaggagaucaggauccucauucuaugcagaaaugaaauggcuccugucaaacacagacaaugcugcuuuuccgcagacgacuaaaucauacaaaaauacaaggaaagacccagcuuuaauaauaugggggauucaccauucuggaucaacuacagaacagaccaagcuauaugggaguggaaacaaacugauaacaguugggaguucuaauuaucaacagucuuuugugccgaguccaggagcgagaccacaaguuaacggccaaucuggaaggauugacuuucauuggcugaugcuaaaucccaaugauacagucacuuucaguuucaauggggccuucauagcuccagaccgugcaagcuuccugagaggaaaaucuaugggaauucagaguggaguacaaguugaugccaauugugaaggggauugcuaucacaauggagggacaauaauaaguaauuugcccuuucagaacauaaauagcagagcaguagggaaauguccgagauauguuaagcaagagagucugcugcuagcaacaggaaugaagaauguuccugagauuccaaagggaagaggucuauuuggugcuauagcagguuucauugaaaauggaugggaaggucuaguugaugggugguaugguuucaggcaucaaaaugcacagggagaggggacugcugcagauuacaaaagcacucagucggcaauugaucaaauaacagggaaauuaaaccggcuuauagaaaaaaccaaccaacaauuugaguuaauagacaaugaguucacugagguugaaaggcaaauuggcaauguaauaaauuggaccagagacuccaugacagaggugugguccuacaaugcugaacucuuaguagcaauggagaaccagcauacaauugaucuggcugauucagaaaugaauaaacuauacgaacgagugaggagacagcugagagagaaugcugaagaagauggcaccgguugcuuugaaauauuucacaagugugaugacgacuguauggccaguauuagaaauaacaccuaugaucacagcaaauacagggaagaggcaaugcaaaauagaauacaaauugauccagucaaacuaagcaguggcuacaaagaugugauacuuugguuuagcuucggggcaucauguuucauacuucuggccauugcaaugggccuugucuucauaugugugaagaauggaaacaugcggugcacuauuuguauauaa

SEQ ID NO: 40723 - RNA, 1683 nt, Artificial Sequence
  hemagglutinin__InfluenzaA__AGQ81003
augaacacucaaauccugguauucgcucugguugcgaucauuccgacaaaugcagacaaaaucugccucggacaucaugcugugucaaacggaacuaaaguaaacacauuaacugaaagaggaguggaagucguuaaugcaacugaaacaguggaacgaacaagcauccccaggaucugcucaaaagggaaaagggcaguugaccucggucaauguggacuccuggggacaaucacugggccaccccaaugugaccaauuccuagaauuuucagcugauuuaauuauugagaggcgagaagggagugaugucuguuauccugggaaguucgugaaugaagaagcucugaggcagauccucagggaaucaggcggaauugacaaggaaacaaugggauucacauacagcgggauaagaacuaauggagcaaccagugcauguaggagaucaggauccucauucuaugcagaaaugaaauggcuccugucaaacacagacaaugcugcuuuuccgcagacgacuaaaucauacaaaaauacaaggaaagacccagcuuuaauaauaugggggauucaccauucuggaucaacuacagaacagaccaagcuauaugggaguggaaacaaacugauaacaguugggaguucuaauuaucaacagucuuuugugccgaguccaggagcgagaccacaaguuaacggccaaucuggaaggauugacuuucauuggcugaugcuaaaucccaaugauacagucacuuucaguuucaauggggccuucauagcuccagaccgugcaagcuuccugagaggaaaaucuaugggaauucagaguggaguacaaguugaugccaauugugaaggggauugcuaucacaauggagggacaauaauaaguaauuugcccuuucagaacauaaauagcagagcaguagggaaauguccgagauauguuaagcaagagagucugcugcuagcaacaggaaugaagaauguuccugagauuccaaagggaagaggucuauuuggugcuauagcagguuucauugaaaauggaugggaaggucuaguugaugggugguaugguuucaggcaucaaaaugcacagggagaggggacugcugcagauuacaaaagcacucagucggcaauugaucaaauaacagggaaauuaaaccggcuuauagaaaaaaccaaccaacaauuugaguuaauagacaaugaguucacugagguugaaaggcaaauuggcaauguaauaaauuggaccagagacuccaugacagaggugugguccuacaaugcugaacucuuagucgcaauggagaaccagcauacaauugaucuggcugauucagaaaugaauaaacuauacgaacgagugaggagacagcugagagagaaugcugaagaagauggcaccgguugcuuugaaauauuucacaagugugaugacgacuguauggccaguauuagaaauaacaccuaugaucacagcaaguacagggaagaggcaaugcaaaauagaauacaaauugauccagucaaacuaagcaguggcuacaaagaugugauacuuugguuuagcuucggggcaucauguuucauacuucuggccauugcaaugggccuugucuucauaugugugaagaauggaaacaugcggugcacuauuuguauauaa

SEQ ID NO: 40724 - RNA, 1683 nt, Artificial Sequence; identical to SEQ ID NO: 40722
  hemagglutinin__InfluenzaA__AGQ81004

SEQ ID NO: 40725 - RNA, 1683 nt, Artificial Sequence
  hemagglutinin__InfluenzaA__AGQ81005
augaacacucaaauccugguauucgcucugguugcgaucauuccgacaaaugcagacaaaaucugccucggacaucaugcugugucaaacggaacuaaaguaaacacauuaacugaaagaggaguggaagucguuaaugcaacugaaacaguggaacgaacaagcauccccaggaucugcucaaaagggaaaagggcaguugaccucggucaauguggacuccuggggacaaucacugggccaccccaaugugaccaauuccuagaauuuucagcugauuuaauuauugagaggcgagaagggagugaugucuguuauccugggaaguucgugaaugaagaagcucugaggcagauccucagggaaucaggcggaauugacaaggaaacaaugggauucacauacagcgggauaagaacuaauggagcaaccagugcauguaggagaucaggauccucauucuaugcagaaaugaaauggcuccugucaaacacagacaaugcugcuuuuccgcagacgacuaaaucauacaaaaauacaaggaaagacccagcuuuaauaauaugggggauucaccauucuggaucaacuacagaacagaccaagcuauaugggaguggaaacaaacugauaacaguugggaguucuaauuaucaacagucuuuugugccgaguccaggagcgagaccacaaguuaacggccaaucuggaaggauugacuuucauuggcugaugcuaaaucccaaugauacagucacuuucaguuucaauggggccuucauagcuccagaccgugcaagcuuccugagaggaaaaucuaugggaauucagaguggaguacaaguugaugccaauugugaaggggauugcuaucacaauggagggacaauaauaaguaauuugcccuuucagaacauaaauagcagagcaguagggaaauguccgagauauguuaagcaagagagucugcugcuagcaacaggaaugaagaauguuccugagauuccaaagggaagaggucuauuuggugcuauagcagguuucauugaaaauggaugggaaggucuaguugaugggugguaugguuucaggcaucaaaaugcacagggagaggggacugcugcagauuacaaaagcacucagucggcaauugaucaaauaacagggaaauuaaaccggcuuauagaaaaaaccaaccaacaauuugaguuaauagacaaugaguucacugagguugaaaggcaaauuggcaauguaauaaauuggaccagagacuccaugacagaggugugguccuacaaugcugaacucuuaguagcaauggagaaccagcauacaauugaucuggcugauucagaaaugaacaaacuauacgaacgagugaggagacagcugagagagaaugcugaagaagauggcaccgguugcuuugaaauauuucacaagugugaugacgacuguauggccaguauuagaaauaacaccuaugaucacagcaaauacagggaagaggcaaugcaaaauagaauacaaauugauccagucaaacuaagcaguggcuacaaagaugugauacuuugguuuagcuucggggcaucauguuucauacuucuggccauugcaaugggccuugucuucauaugugugaagaauggaaacaugcggugcacuauuuguauauaa

SEQ ID NO: 40726 - RNA, 1683 nt, Artificial Sequence
  hemagglutinin__InfluenzaA__AGQ81006
augaacacucaaauccugguauucgcucugguugcgaucauuccgacaaaugcagacaaaaucugccucggacaucaugcugugucaaacggaacuaaaguaaacacauuaacugaaagaggaguggaagucguuaaugcaacugaaacaguggaacgaacaagcauccccaggaucugcucaaaagggaaaagggcaguugaccucggucaauguggacuccuggggacaaucacugggccaccccaaugugaccaauuccuagaauuuucagcugauuuaauuauugagaggcgagaagggagugaugucuguuauccugggaaguucgugaaugaagaagcucugaggcagauccucagggaaucaggcggaauugacaaggaaacaaugggauucacauacagcgggauaagaacuaauggagcaaccagugcauguaggagaucaggauccucauucuaugcagaaaugaaauggcuccugucaaacacagacaaugcugcuuuuccgcagacgacuaaaucauacaaaaauacaaggaaagacccagcuuuaauaauaugggggauucaccauucuggaucaacuacagaacagaccaagcuauaugggaguggaaacaaacugauaacaguugggaguucuaacuaucaacagucuuuugugccgaguccaggagcgagaccacaaguuaacggccaaucuggaaggauugacuuucauuggcugaugcuaaaucccaaugauacagucacuuucaguuucaauggggccuucauagcuccagaccgugcaagcuuccugagaggaaaaucuaugggaauucagaguggaguacaaguugaugccaauugugaaggggauugcuaucacaauggagggacaauaauaaguaauuugcccuuucagaacauaaauagcagagcaguagggaaauguccgagauauguuaagcaagagagucugcugcuagcaacaggaaugaagaauguuccugagauuccaaagggaagaggucuauuuggugcuauagcagguuucauugaaaauggaugggaaggucuaguugaugggugguaugguuucaggcaucaaaaugcacagggagaggggacugcugcagauuacaaaagcacucagucggcaauugaucaaauaacagggaaauuaaaccggcuuauagaaaaaaccaaccaacaauuugaguuaauagacaaugaguucacugagguugaaaggcaaauuggcaauguaauaaauuggaccagagacuccaugacagaggugugguccuacaaugcugaacucuuaguagcaauggagaaccagcauacaauugaucuggcugauucagaaaugaauaaacuauacgaacgagugaggagacagcugagagagaaugcugaagaagauggcaccgguugcuuugaaauauuucacaagugugaugacgacuguauggccaguauuagaaauaacaccuaugaucacagcaaauacagggaagaggcaaugcaaaauagaauacaaauugauccagucaaacuaagcaguggcuacaaagaugugauacuuugguuuagcuucggggcaucauguuucauacuucuggccauugcaaugggccuugucuucauaugugugaagaauggaaacaugcggugcacuauuuguauauaa

SEQ ID NO: 40727 - RNA, 1683 nt, Artificial Sequence
  hemagglutinin__InfluenzaA__AGQ81007
augaacacucaaauccugguauucgcucugguugcgaucauuccgacaaaugcagacaaaaucugccucggacaucaugcugugucaaacggaacuaaaguaaacacauuaacugaaagaggaguggaagucguuaaugcaacugaaacaguggaacgaacaagcauccccaggaucugcucaaaagggaaaagggcaguugaccucggucaauguggacuccuggggacaaucacugggccaccccaaugugaccaauuccuagaauuuucagcugauuuaauuauugagaggcgagaagggagugaugucuguuauccugggaaguucgugaaugaagaagcucugaggcagauccucagggaaucaggcggaauugacaaggaaacaaugggauucacauacagcgggauaagaacuaauggagcaaccagugcauguaggagaucaggauccucauucuaugcagaaaugaaauggcuccugucaaacacagacaaugcugcuuucccgcagacgacuaaaucauacaaaaauacaaggaaagacccagcuuuaauaauaugggggauucaccauucuggaucaacuacagaacagaccaagcuauaugggaguggaaacaaacugauaacaguugggaguucuaauuaucaacagucuuuugugccgaguccaggagcgagaccacaaguuaacggccaaucuggaaggauugacuuucauuggcugaugcuaaaucccaaugauacagucacuuucaguuucaauggggccuucauagcuccagaccgugcaagcuuccugagaggaaaaucuaugggaauucagaguggaguacaaguugaugccaauugugaaggggauugcuaucacaauggagggacaauaauaaguaauuugcccuuucagaacauaaauagcagagcaguagggaaauguccgagauauguuaagcaagagagucugcugcuagcaacaggaaugaagaauguuccugagauuccaaagggaagaggucuauuuggugcuauagcagguuucauugaaaauggaugggaaggucuaguugaugggugguaugguuucaggcaucaaaaugcacagggagaggggacugcugcagauuacaaaagcacucagucggcaauugaucaaauaacagggaaauuaaaccggcuuauagaaaaaaccaaccaacaauuugaguuaauagacaaugaguucacugagguugaaaggcaaauuggcaauguaauaaauuggaccagagacuccaugacagaggugugguccuacaaugcugaacucuuaguagcaauggagaaccagcauacaauugaucuggcugauucagaaaugaauaaacuauacgaacgagugaggagacagcugagagagaaugcugaagaagauggcaccgguugcuuugaaauauuucacaagugugaugacgacuguauggccaguauuagaaauaacaccuaugaucacagcaaguacagggaagaggcaaugcaaaauagaauacaaauugauccagucaaacuaagcaguggcuacaaagaugugauacuuugguuuagcuucggggcaucauguuucauacuucuggccauugcaaugggccuugucuucauaugugugaagaauggaaacaugcggugcacuauuuguauauaa

SEQ ID NO: 40728 - RNA, 1683 nt, Artificial Sequence
  hemagglutinin__InfluenzaA__AGQ81008
augaacacucaaauccugguauucgcucugguugcgaucauuccgacaaaugcagacaaaaucugccucggacaucaugcugugucaaacggaacuaaaguaaacacauuaacugaaagaggaguggaagucguuaaugcaacugaaacaguggaacgaacaagcauccccaggaucugcucaaaagggaaaagggcaguugaccucggucaauguggacuccuggggacaaucacugggccaccccaaugugaccaauuccuagaauuuucagcugauuuaauuauugagaggcgagaagggagugaugucuguuauccugggaaguucgugaaugaagaagcucugaggcagauccucagggaaucaggcggaauugacaaggaaacaaugggauucacauacagcgggauaagaacuaauggagcaaccagugcauguaggagaucaggauccucauucuaugcagaaaugaaauggcuccugucaaacacagacaaugcugcuuuuccgcagacgacuaaaucauacaaaaauacaaggaaagacccagcuuuaauaauaugggggauucaccauucuggaucaacuacagaacagaccaagcuauaugggaguggaaacaaacugauaacaguugggaguucuaauuaucaacagucuuuugugccgaguccaggagcgagaccacaaguuaacggccaaucuggaaggauugacuuucauuggcugaugcuaaaucccaaugauacagucacuuucaguuucaauggggccuucauagcuccagaccgugcaagcuuccugagaggaaaaucuaugggaauucagaguggaguacaaguugaugccaauugugaaggggauugcuaucauaauggagggacaauaauaaguaauuugcccuuucagaacauaaauagcagagcaguagggaaauguccgagauauguuaagcaagagagucugcugcuagcaacaggaaugaagaauguuccugagauuccaaagggaagaggucuauuuggugcuauagcagguuucauugaaaauggaugggaaggucuaguugaugggugguaugguuucaggcaucaaaaugcacagggagaggggacugcugcagauuacaaaagcacucagucggcaauugaucaaauaacagggaaauuaaaccggcuuauagaaaaaaccaaccaacaauuugaguuaauagacaaugaguucacugagguugaaaggcaaauuggcaauguaauaaauuggaccagagacuccaugacagaggugugguccuacaaugcugaacucuuagucgcaauggagaaccagcauacaauugaucuggcugauucagaaaugaauaaacuauacgaacgagugaggagacagcugagagagaaugcugaagaagauggcaccgguugcuuugaaauauuucacaagugugaugacgacuguauggccaguauuagaaauaacaccuaugaucacagcaaguacagggaagaggcaaugcaaaauagaauacaaauugauccagucaaacuaagcaguggcuacaaagaugugauacuuugguuuagcuucggggcaucauguuucauacuucuggccauugcaaugggccuugucuucauaugugugaagaauggaaacaugcggugcacuauuuguauauaa

SEQ ID NO: 40729 - RNA, 1683 nt, Artificial Sequence
  hemagglutinin__InfluenzaA__AGQ81009
augaacacucaaauccugguauucgcucugguugcgaucauuccgacaaaugcagacaaaaucugccucgggcaucaugcugugucaaacggaacuaaaguaaacacauuaacugaaagaggaguggaagucguuaaugcaacugaaacaguggaacgaacaagcauccccaggaucugcucaaaagggaaaagggcaguugaccucggucaauguggacuccuggggacaaucacugggccaccccaaugugaccaauuccuagaauuuucagcugauuuaauuauugagaggcaagaagggagugaugucuguuauccugggaaguucgugaaugaagaagcucugaggcagauccucagggaaucaggcggaauuaacaaggaaacaaugggauucacauacagcgggauaagaacuaauggagcaaccagugcauguaggagaucaggguccucauucuaugcagaaaugaaauggcuccugucaaauacagacaaugcugcuuuuccgcagacgacuaaaucauacaaaaauacaaggaaagacccagcuuuaauaauaugggggauucaccauucuggaucaacuacagaacagaccaagcuauaugggaguggaaacaaacugauaacaguugggaguucuaauuaucaacagucuuuugugccgaguccaggagcgagaccacaaguuaacggccaaucuggaaggauugacuuucauuggcugaugcuaaaucccaaugauacagucacuuucaguuucaauggggccuucauagcuccagaccgugcaagcuuccugagaggaaaaucuaugggaauucaaaguggaguacaaguugaugccaauugugaaggggauugcuaucacaauggagggacaauaauaaguaauuugcccuuucagaacauaaauagcagagcaguagggaaauguccgagauauguuaagcaagagagucugcugcuagcaacaggaaugaagaauguuccugagauuccaaagggaagaggucuauuuggugcuauagcagguuucauugaaaauggaugggaaggucuaguugaugggugguaugguuucaggcaucaaaaugcacagggagaggggacugcugcagauuacaaaagcacucagucggcaauugaucaaauaacagggaaauuaaaccggcuuauagaaaaaaccaaccaacaauuugaguuaauagacaaugaguucacugagguugaaaggcaaauuggcaauguaauaaauuggaccagagacuccaugacagaggugugguccuacaaugcugaacucuuaguagcaauggagaaccagcauacaauugaucuggcugauucagaaaugaauaaacuauacgaacgagugaggagacagcugagagagaaugcugaagaagauggcaccgguugcuuugaaauauuucacaagugugaugacgacuguauggccaguauuagaaauaacaccuaugaucacagcaaguacagggaagaggcaaugcaaaauagaauacaaauugauccagucaaacuaagcaguggcuacaaagaugugauacuuugguuuagcuucggggcaucauguuucauacuucuggccauugcaaugggccuugucuucauaugugugaagaauggaaacaugcggugcacuauuuguauauaa

SEQ ID NO: 40730 - RNA, 1683 nt, Artificial Sequence
  hemagglutinin__InfluenzaA__AGQ81011
augaacacucaaauccuaguauucgcucugauugcgaucacuccaacaaauucagacaaaaucugccucggacaucaugcugugucaaacggaaccaaaguaaacacauuaacugaaagaggaguggaagucgucaaugcaacugaaacaguggaacgaacaagcauccccaggaucugcucaaaagggaaaagaacaguugaccucggucaauguggacuccuagggacaaucacugggccaccucaaugugaccaauuccuagaauuuucagccgauuuaauuauugagaggcgagaaggaagugaugucuguuauccugggaaauucgugaaugaagaagcucugaggcaaauucucagggaaucaggcggaaucgacaaggaagcaaugggauucacauacagcggaauaagaacuaauggagcaaccagugccuguaggagaucagaaucuucauucuaugcagaaaugaaauggcuccuaucaaacacagauaaugcugcuuucccgccgaugacuaagucauauaaaaauacaagaaaggccccagcucuaauaauaugggggauccaucauuccggaucaacugcagagcaaaccaagcuauaugggaguggaaacaaacuggugacaguuaggaguucuaauuaucaacaaucuuuugugccgaguccaggagcgggaccaaaaguuaauggucaaucuggaaggauugacuuucauuggcuaaugcuaaaucccaaugacacagucaccuucagcuucaauggggcuuucauagcuccagaccgugcaagcuuccugagagggaaaucuaugggaauccagaguggaguacagguugaugccaauugugaaggggacugcuaucauaguggagggacaauaauaaguaauuugccauuucagaacauagacagcagaguaguaggaaaauguccgagauauguuaagcaaaagagucugcugcuagcaacagggaugaagaauguuccugagauuccaaagggaagaggccuauuuggugcuauagcggguuucauugaaaauggaugggaaggccuaauugaugggugguaugguuucagacaccagaaugcacagggagagggaacugcugcagauuacaaaagcacucaaucggcaauuaaucaaaugacagggaaauuaaaccggcuuauagaaaaaaccaaccaacaauuugaguugauagacaaugaauucacugagguagagaagcaaauugguaaugugauaaauuggaccagagacucuauaacagaaguguggucauacaaugcugaacucuugguagcaauggagaaccagcauacaauugaucuggcugauucagaaaugaacaaacuguacgaacgagugaaaagacagcugagagagaaugcugaagaagauggcacugguugcuuugaaauauuucacaaaugugaugaugacuguauggccaguauuagaaauaacaccuaugaucacagcaaauacagggaggaagcaaugcaaaauagaauacagauugacccagucaaacuaagcagcggcuacaaagaugugauacuuugguuuagcuucggggcaucauguuuaauacuucuagccauugcaaugggccuugucuucauaugugugaaaaauggaaacaugcggugcacuauuuguauauaa

SEQ ID NO: 40731 - RNA, 1683 nt, Artificial Sequence
  hemagglutinin__InfluenzaA__AGQ81012
augaacacucaaauccuaguauucgcucugauugcgaucauuccaacaaauucagacaaaaucugccucggacaucaugcugugucaaacggaaccaaaguaaacacauuaacugaaagaggaguggaagucgucaaugcaacugaaacaguggaacgaacaagcauccccaggaucugcucaaaagggaaaagaacaguugaccucggucaauguggacuccuagggacaaucacugggccaccucaaugugaccaauuccuagaauuuucagccgauuuaauuauugagaggcgagaaggaagugaugucuguuauccugggaaauucgugaaugaagaagcucugaggcaaauucucagggaaucaggcggaaucaacaaggaagcaaugggauucacauacagcggaauaagaacuaauggagcaaccagugcauguaggagaucaggaucuucauucuaugcagaaaugaaauggcuccuaucaaacacagauaaugcugcuuucccgccgaugacuaagucauauaaaaauacaagaaaggccccagcucuaauaauaugggggauccaucauuccggaucaacugcagagcaaaccaagcuauaugggaguggaaacaaacuggugacaguuaggaguucuaauuaucaacaaucuuuugugccgaguccaggagcaggaccacaaguuaauggucaaucuggaaggauugacuuucauuggcuaaugcuaaaucccaaugacacagucaccuucagcuucaauggggcuuucauagcuccagaccgugcaagcuuccugagagggaaaucuaugggaauccagaguggaguacagguugaugccaauugugaaggggacugcuaucauaguggagggacaauaauaaguaauuugccauuucagaacauagacagcagaguaguaggaaaauguccgagauauguuaagcaaaagagucugcugcuagcaacagggaugaagaauguuccugagauuccaaagggaagaggccuauuuggugcuauagcggguuucauugaaaauggaugggaaggccuaauugaugggugguaugguuucagacaccagaaugcacagggagagggaacugcugcagauuacaaaagcacucaaucggcaauuaaucaaaugacaggaaaauuaaaccggcuuauagaaaaaaccaaccaacaauuugaguugauagacaaugaauucacugagguagagaagcaaauugguaaugugauaaauuggaccagagacucuauaacagaaguguggucauacaaugcugaacucuugguagcaauggagaaccagcauacaauugaucuggcugauucagaaaugaacaaacuguacgaacgagugaaaagacagcugagagagaaugcugaagaagauggcacugguugcuuugaaauauuucacaaaugugaugaugacuguauggccaguauuagaaauaacaccuaugaucacagcaaauacagggaggaagcaaugcaaaauagaauacagauugacccagucaaacuaagcagcggcuacaaagaugugauacuuugguuuagcuucggggcaucauguuucauacuucuagccauugcaaugggccuugucuucauaugugugaaaaauggaaacaugcggugcacuauuuguauauaa

SEQ ID NO: 40732 - RNA, 1683 nt, Artificial Sequence
  hemagglutinin__InfluenzaA__AGQ81017
augaacacucaaauccuaguauucgcucugauugcgaucacuccaacaaauucagacaaaaucugccucggacaucaugcugugucaaacggaaccaaaguaaacacauuaacugaaagaggaguggaagucgucaaugcaacugaaacaguggaacgaacaagcauccccaggaucugcucaaaagggaaaagaacaguugaccucggucaauguggacuccuagggacaaucacugggccaccucaaugugaccaauuccuagaauuuucagccgauuuaauuauugagaggcgagaaggaagugaugucuguuauccugggaaauucgugaaugaagaagcucugaggcaaauucucagggaaucaggcggaaucgacaaggaagcaaugggauucacauacagcggaauaagaacuaauggagcaaccagugcauguaggagaucaggaucuucauucuaugcagaaaugaaauggcuccuaucaaacacagauaaugcugcuuucccgccgaugacuaagucauauaaaaauacaagaaaggccccagcucuaauaauaugggggauccaucauuccggaucaacugcagagcaaacaaagcuauaugggaguggaaacaaacuggugacaguuaggaguucuaauuaucaacaaucuuuugugccgaguccaggagcgggaccacaaguuaauggucaaucuggaaggauugacuuucauuggcuaaugcuaaaucccaaugacacagucaccuucagcuucaauggggcuuucauagcuccagaccgugcaagcuuccugagagggaaaucuaugggaauccagaguggaguacagguugaugccaauugugaaggggacugcuaucauaguggagggacaauaauaaguaauuugccauuucagaacauagacagcagaguaguaggaaaauguccgagauauguuaagcaaaagagucugcugcuagcaacagggaugaagaauguuccugagauuccaaagggaagaggccuauuuggugcuauagcggguuucauugaaaauggaugggaaggccuaauugaugggugguaugguuucagacaccagaaugcacagggagagggaacugcugcagauuacaaaagcacucaaucggcaauuaaucaaaugacaggaaaauuaaaccggcuuauagaaaaaaccaaccaacaauuugaguugauagacaaugaauucacugagguagagaagcaaauugguaaugugauaaauuggaccagagacucuauaacagaaguguggucauacaaugcugaacucuugguagcaauggagaaccagcauacaauugaucuggcugauucagaaaugaacaaacuguacgaacgagugaaaagacagcugagagagaaugcugaagaagauggcacugguugcuuugaaauauuucacaaaugugaugaugacuguauggccaguauuagaaauaacaccuaugaucacagcaaauacagggaggaagcaaugcaaaauagaauacagauugacccagucaaacuaagcagcggcuacaaagaugugauacuuugguuuagcuucggggcaucauguuucauacuucuagccauugcaaugggccuugucuucauaugugugaaaaauggaaacaugcggugcacuauuuguauauaa

SEQ ID NO: 40733 - RNA, 1683 nt, Artificial Sequence
  hemagglutinin__InfluenzaA__AGQ81018
augaacacucaaauccuaguauucgcucugauugcgaucauuccaacaaauucagacaaaaucugccucggacaucaugcugugucaaacggaaccaaaguaaacacauuaacugaaagaggaguggaagucgucaaugcaacugaaacaguggaacgaacaagcauccccaggaucugcucaaaaggaaaaagaacaguugaccucggucaauguggacuccuagggacaaucacugggccaccucaaugugaccaauuccuagaauuuucagccgauuuaauuauugagaggcgagaaggaagugaugucuguuauccugggaaauucgugaaugaagaagcucugaggcaaauucucagggaaucaggcggaaucgucaaggaagcaaugggauucacauacagcggaauaagaacuaauggagcaaccagugcauguaggagaucaggaucuucauucuaugcagaaaugaaauggcuccuaucaaacacagauaaugcugcuuucccgccgaugacuaagucauauaaaaauacaagaaaggccccagcuauaauaauaugggggauccaucauuccggaucaacugcagagcaaaccaagcuauaugggaguggaaacaaacuggugacaguuaggaguucuaauuaucaacaaucuuuugugccgaguccaggagcgggaccacaaguuaauggucaaucuggaaggauugacuuucauuggcuaaugcuaaaucccaaugacacagucaccuucagcuucaauggggcuuucauagcuccagaccgugcaagcuuccugagagggaaaucuaugggaauccagaguggaguacagguugaugccaauugugaaggggacugcuaucauaguagagggacaauaauaaguaauuugccauuucagaacauagacagcagaguaguaggaaaauguccgagauauguuaagcaaaagagucugcugcuagcaacagggaugaagaauguuccugagauuccaaagggaagaggccuauuuggugcuauagcggguuucauugaaaauggaugggaaggccuaauugaugggugguaugguuucagacaccagaaugcacagggagagggaacugcugcagauuacaaaagcacucaaucggcaauuaaucaaaugacaggaaaauuaaaccggcuuauagaaaaaaccaaccaacaauuugaguugauagacaaugaauucacugagguagagaagcaaauugguaaugugauaaauuggaccagagacucuauaacagaaguguggucauacaaugcugaacucuugguagcaauggagaaccagcauacaauugaucuggcugauucagaaaugaacaaacuguacgaacgagugaaaagacagcugagagagaaugcugaagaagauggcacugguugcuuugaaauauuucacaaaugugaugaugacuguauggccaguauuagaaauaacaccuaugaucacagcaaauacagggaggaagcaaugcaaaauagaauacagauugacccagucaaacuaagcagcggcuacaaagaugugauacuuugguuuagcuucggggcaucauguuucauacuucuagccauugcaaugggccuugucuucauaugugugaaaaauggaaacaugcggugcacuauuuguauauaa

SEQ ID NO: 40734 - RNA, 1683 nt, Artificial Sequence
  hemagglutinin__InfluenzaA__AGQ81019
augaacacucaaauccuaguauucgcucugauugcgaucauuccaacaaauucagacaaaaucugccucggacaucaugcugugucaaacggaaccaaaguaaacacauuaacugaaagaggaguggaagucgucaaugcaacugaaacaguggaacgaacaagcauccccaggaucugcucaaaagggaaaagaacaguugaccucggucaauguggacuccuagggacaaucacugggccaccucaaugugaccaauuccuagaauuuucagccgauuuaauuauugagaggcgagaaggaagugaugucuguuauccugggaaauucgugaaugaagaagcucugaggcaaauucucagggaaucaggcggaaucgucaaggaagcaaugggauucacauacagcggaauaagaacuaauggagcaaccagugcauguaggagaucaggaucuucauucuaugcagaaaugaaauggcuccuaucaaacacagauaaugcugcuuucccgccgaugacuaagucauauaaaaauacaagaaaggccccagcuauaauaauaugggggauccaucauuccggaucaacugcagagcaaaccaagcuauaugggaguggaaacaaacuggugacaguuaggaguucuaauuaucaacaaucuuuugugccgaguccaggagcgggaccacaaguuaauggucaaucuggaaggauugacuuucauuggcuaaugcuaaaucccaaugacacagucaccuucagcuucaauggggcuuucauagcuccagaccgugcaagcuuccugagagggaaaucuaugggaauccagaguggaguacagguugaugccaauugugaaggggacugcuaucauaguagagggacaauaauaaguaaucugccauuucagaacauagacagcagaguaguaggaaaauguccgagauauguuaagcaaaagagucugcugcuagcaacagggaugaagaauguuccugagauuccaaagggaagaggccuauuuggugcuauagcggguuucauugaaaauggaugggaaggccuaauugaugggugguaugguuucagacaccagaaugcacagggagagggaacugcugcagauuacaaaagcacucaaucggcaauuaaucaaaugacaggaaaauuaaaccggcuuauagaaaaaaccaaccaacaauuugaguugauagacaaugaauucacugagguagagaagcaaauugguaaugugauaaauuggaccagagacucuauaacagaaguguggucauacaaugcugaacucuugguagcaauggagaaccagcauacaauugaucuggcugauucagaaaugaacaaacuguacgaacgagugaaaagacagcugagagagaaugcugaagaagauggcacugguugcuuugaaauauuucacaaaugugaugaugacuguauggccaguauuagaaauaacaccuaugaucacagcaaauacagggaggaagcaaugcaaaauagaauacagauugacccagucaaacuaagcagcggcuacaaagaugugauacuuugguuuagcuucggggcaucauguuucauacuucuagccauugcaaugggccuugucuucauaugugugaaaaauggaaacaugcggugcacuauuuguauauaa

SEQ ID NO: 40735 - RNA, 1683 nt, Artificial Sequence
  hemagglutinin__InfluenzaA__AGQ81020
augaacacucaaauccuaguauucgcucugauugcgaucacuccaacaaauucagacaaaaucugccucggacaucaugcugugucaaacggaaccaaaguaaacacauuaacugaaagaggaguggaagucgucaaugcaacugaaacaguggaacgaacaagcauccccaggaucugcucaaaagggaaaagaacaguugaccucggucaauguggacuccuagggacaaucacugggccaccucaaugugaccaauuccuagaauuuucagccgauuuaauuauugagaggcgagaaggaagugaugucuguuauccugggaaauucgugaaugaagaagcucugaggcaaauucucagggaaucaggcggaaucgacaaggaagcaaugggauucacauacagcggaauaagaacuaauggagcaaccagugcauguaggagaucaggaucuucauucuaugcagaaaugaaauggcuccuaucaaacacagauaaugcugcuuucccgccgaugacuaagucauauaaaaauacaagaaaggccccagcucuaauaauaugggggauccaucauuccggaucaacugcagagcaaaccaagcuauaugggaguggaaacaaacuggugacaguuaggaguucuaauuaucaacaaucuuuugugccgaguccaggagcgggaccacaaguuaauggucaaucuggaaggauugacuuucauuggcuaaugcuaaaucccaaugacacagucaccuucagcuucaauggggcuuucauagcuccagaccgugcaagcuuccugagagggaaaucuaugggaauccagaguggaguacagguugaugccaauugugaaggggacugcuaucauaguggagggacaauaauaaguaauuugccauuucagaacauagacagcagaguaguaggaaaauguccgagauauguuaagcaaaagagucugcugcuagcaacagggaugaagaauguuccugagauuccaaagggaagaggccuauuuggugcuauagcggguuucauugaaaauggaugggaaggccuaauugaugggugguaugguuucagacaccagaaugcacagggagagggaacugcugcagauuacaaaagcacucaaucggcaauuaaucaaaugacaggaaaauuaaaccggcuuauagaaaaaaccaaccaacaauuugaguugauagacaaugaauucacugagguagagaagcaaauugguaaugugauaaauuggaccagagacucuauaacagaaguguggucauacaaugcugaacucuugguagcaauggagaaccagcauacaauugaucuggcugauucagaaaugaacaaacuguacgaacgagugaaaagacagcugagagagaaugcugaagaagauggcacugguugcuuugaaauauuucacaaaugugaugaugacuguauggccaguauuagaaauaacaccuaugaucacagcaaauacagggaggaagcaaugcaaaauagaauacagauugacccagucaaacuaagcagcggcuacaaagaugugauacuuugguuuagcuucggggcaucauguuucauacuucuagccauugcaaugggccuugucuucauaugugugaaaaauggaaacaugcggugcacuauuuguauauaa

SEQ ID NO: 40736 - RNA, 1683 nt, Artificial Sequence
  hemagglutinin__InfluenzaA__AGQ81021
augaacacucaaauccuaguauucgcucugauugcgaucauuccaacaaauucagacaaaaucugccucggacaucaugcugugucaaacggaaccaaaguaaacacauuaacugaaagaggaguggaagucgucaaugcaacugaaacaguggaacgaacaagcauccccaggaucugcucaaaagggaaaagaacaguugaccucggucaauguggacuccuagggacaaucacugggccaccucaaugugaccaauuccuagaauuuucagccgauuuaauuauugagaggcgagaaggaagugaugucuguuauccugggaaauucgugaaugaagaagcucugaggcaaauucucagggaaucaggcggaaucgucaaggaagcaaugggauucacauacagcggaauaagaacuaauggagcaaccagugcauguaggagaucaggaucuucauucuaugcagaaaugaaauggcuccuaucaaacacagauaaugcugcuuucccgccgaugacuaagucauauaaaaauacaagaaaggccccagcuauaauaauaugggggauccaucauuccggaucaacugcagagcaaaccaagcuauaugggaguggaaacaaacuggugacaguuaggaguucuaauuaucaacaaucuuuugugccgaguccaggagcgggaccacaaguuaauggucaaucuggaaggauugacuuucauuggcuaaugcuaaaucccaaugacacagucaccuucagcuucaauggggcuuucauagcuccagaccgugcaagcuuccugagagggaaaucuaugggaauccagaguggaguacagguugaugccaauugugaaggggacugcuaucauaguagagggacaauaauaaguaauuugccauuucagaacauagacagcagaguaguaggaaaauguccgagauauguuaagcaaaagagucugcugcuagcaacagggaugaagaauguuccugagauuccaaagggaagaggccuauuuggugcuauagcggguuucauugaaaauggaugggaaggccuaauugaugggugguaugguuucagacaccagaaugcacagggagagggaacugcugcagauuacaaaagcacucaaucggcaauuaaucaaaugacaggaaaauuaaaccggcuuauagaaaaaaccaaccaacaauuugaguugauagacaaugaauucacugagguagagaagcaaauugguaaugugauaaauuggaccagagacucuauaacagaaguguggucauacaaugcugaacucuugguagcaauggagaaccagcauacaauugaucuggcugauucagaaaugaacaaacuguacgaacgagugaaaagacagcugagagagaaugcugaagaagauggcacugguugcuuugaaauauuucacaaaugugaugaugacuguauggccaguauuagaaauaacaccuaugaucacagcaaauacagggaggaagcaaugcaaaauagaauacagauugacccagucaaacuaagcagcggcuacaaagaugugauacuuugguuuagcuucggggcaucauguuucauacuucuagccauugcaaugggccuugucuucauaugugugaaaaauggaaacaugcggugcacuauuuguauauaa

SEQ ID NO: 40737 - RNA, 1683 nt, Artificial Sequence; identical to SEQ ID NO: 40735
  hemagglutinin__InfluenzaA__AGQ81022

SEQ ID NO: 40738 - RNA, 1683 nt, Artificial Sequence; identical to SEQ ID NO: 40736
  hemagglutinin__InfluenzaA__AGQ81023

SEQ ID NO: 40739 - RNA, 1683 nt, Artificial Sequence
  hemagglutinin__InfluenzaA__AGQ81025
augaacacucaaauccuaguauucgcucugauugcgaucauuccaacaaaugcagacaaaaucugccucggacaucaugcugugucaaacggaaccaaaguaaacacauuaacugaaagaggaguggaagucgucaaugcaacugaaacaguggaacgaacaagcauccccaggaucugcucaaaagggaaaagaacaguugaccucggucaauguggacuccuagggacaaucacugggccaccucaaugugaccaauuccuagaauuuucagccgauuuaauuauugagaggcgagaaggaagugaugucuguuauccugggaaauucgugaaugaagaagcucugaggcaaauucucagggagucaggcggaaucgacaaggaagcaaugggauucacauacaguggaauaagaacuaauggaguaaccagugcauguaggagaucaggaucuucauucuaugcagaaaugaaauggcuccuaucaaacacagauaaugcugcuuucccgccgaugacuaagucauauaaaaauacaagaaaggccccagcucuaauaauaugggggauccaucauuccggaucaacugcagagcaaaccaagcuauaugggaguggaaacaaacuggugacaguuaggaguucuaauuaucaacaaucuuuugugccgaguccaggagcgggaccacaaguuaauggucaaucuggaaggauugacuuucauuggcuaaugcuaaaucccaaugacacagucaccuucagcuucaauggggcuuucauagcuccagaccgugcaagcuuccugagagggaaaucuaugggaauccagaguggaguacagguugaugccaauugugaaggggacugcuaucauaguggagggacaauaauaaguaauuugccauuucagaacauagacagcagaguaguaggaaaauguccgagauauguuaagcaaaagagucugcugcuagcaacagggaugaagaauguuccugagauuccaaagggaagaggccuauuuggugcuauagcggguuucauugaaaauggaugggaaggccuaauugaugggugguaugguuucagacaccagaaugcacagggagagggaacugcugcagauuacaaaagcacucaaucggcaauuaaucaaaugacaggaaaauuaaaccggcuuauagaaaaaaccaaccaacaauuuggguugauagacaaugaauucacugagguagagaagcaaauugguaaugugauaaauuggaccagagacucuauaacagaaguguggucauacaaugcugaacucuugguagcaauggagaaccagcauacaauugaucuggcugauucagaaaugaacaaacuguacgaacgagugaaaagacagcugagagagaaugcugaagaagauggcacugguugcuuugaaauauuucacaaaugugaugaugacuguauggccaguauuagaaauaacaccuaugaucacagcaaauacagggaggaagcaaugcaaaauagaauacagauugacccagucaaacuaagcagcggcuacaaggaugugauacuuugguuuagcuucggggcaucauguuucauacuucuagccauugcaaugggccuugucgucauaugugugaaaaauggaaacaugcggugcacuauuuguauauaa

SEQ ID NO: 40740 - RNA, 1683 nt, Artificial Sequence
  hemagglutinin__InfluenzaA__AGQ81026
augaacacucaaauccuaguauucgcucugauugcgaucauuccaacaaaugcagacaaaaucugccucggacaucaugcugugucaaacggaaccaaaguaaacacauuaacugaaagaggaguggaagucgucaaugcaacugaaacaguggaacgaacaagcauccccaggaucugcucaaaagggaaaagaacaguugaccucggucaauguggacuccuagggacaaucacugggccaccucaaugugaccaauuccuagaauuuucagccgauuuaauuauugagaggcgagaaggaagugaugucuguuauccugggaaauucgugaaugaagaagcucugaggcaaauucucagggaaucaggcggaaucgacaaggaagcaaugggauucacauacagcggaauaagaacuaauggagcaaccagugcauguaggagaucaggaucuucauucuaugcagaaaugaaauggcuccuaucaaacacagauaaugcugcuuucccgccgacgacuaagucauauaaaaauacaagaaaggccccagcucuaauaauaugggggauccaucauuccggaucaacugcagagcaaaccaagcuauaugggaguggaaacaaacuggugacaguuaggaguucuaauuaucaacaaucuuuugugccgaguccaggagcgggaccacaaguuaauggucaaucuggaaggauugacuuucauuggcuaaugcuaaaucccaaugacacagucaccuuuagcuucaauggggcuuucauagcuccagaccgugcaagcuuccugagagggaaaucuaugggaauccagaguggaguacagguugaugccaauugugaaggggacugcuaucauaguggagggacaauaauaaguaauuugccauuucagaacauagacagcagaguaguaggaaaauguccgagauauguuaagcaaaagagucugcugcuagcaacagggaugaagaauguuccugagauuccaaagggaagaggccuauuuggugcuauagcggguuucauugaaaauggaugggaaggccuaauugaugggugguaugguuucagacaccagaaugcacagggagagggaacugcugcagauuacaaaagcacucaaucggcaauuaaucaaaugacaggaaaauuaaaccgacuuauagaaaaaaccaaccaacaauuugaguugauagacaaugaauucacugagguagagaagcagauugguaaugugauaaauuggaccagagacucuauaacagaaguguggucauacaaugcugaacucuugguagcaauggagaaccagcauacaauugaucuggcugauucagaaaugaacaaacuguacgaacgagugaaaagacagcugagagagaaugcugaagaagauggcacugguugcuuugaaauauuucacaaaugugaugaugacuguauggccaguauuagaaauaacaccuaugaucacagcaaauacagggaggaagcaaugcaaaauagaauacagauugacccagucaaacuaagcagcggcuacaaagaugugauacuuugguuuagcuucggggcaucauguuucauacuucuagccauugcaaugggccuugucuucauaugugugaaaaauggaaacaugcggugcacuauuuguauauaa

SEQ ID NO: 40741 - RNA, 1683 nt, Artificial Sequence
  hemagglutinin__InfluenzaA__AGQ81027
augaacacucaaauccuaguauucgcucugauugcgaucauuccaacaaaugcagacaaaaucugccucggacaucaugcugugucaaacggaaccaaaguaaacacauuaacugaaagaggaguggaagucgucaaugcaacugaaacaguggaacgaacaagcauccccaggaucugcucaaaagggaaaagaacaguugaccucggucaauguggacuccuagggacaaucacugggccaccucaaugugaccaauuccuagaauuuucagccgauuuaauuauugagaggcgagaaggaagugaugucuguuauccugggaaauucgugaaugaagaagcucugaggcaaauucucagggagucaggcggaaucgacaaggaagcaaugggauucacauacagcggaauaagaacuaauggaguaaccagugcauguaggagaucaggaucuucauucuaugcagaaaugaaauggcuccuaucaaacacagauaaugcugcuuucccgccgaugacuaagucauauaaaaauacaagaaaggccccagcucuaauaauaugggggauccaucauuccggaucaacugcagagcaaaccaagcuauaugggaguggaaacaaacuggugacaguuaggaguucuaauuaucaacaaucuuuugugccgaguccaggagcgggaccacaaguuaauggucaaucuggaaggauugacuuucauuggcuaaugcuaaaucccaaugacacagucaccuucagcuucaauggggcuuucauagcuccagaccgugcaagcuuccugagagggaaaucuaugggaauccagaguggaguacagguugaugccaauugugaaggggacugcuaucauaguggagggacaauaauaaguaauuugccauuucagaacauagacagcagaguaguaggaaaauguccgagauauguuaagcaaaagagucugcugcuagcaacagggaugaagaauguuccugagauuccaaagggaagaggccuauuuggugcuauagcggguuucauugaaaauggaugggaaggccuaauugaugggugguaugguuucagacaccagaaugcacagggagagggaacugcugcagauuacaaaagcacucaaucggcaauuaaucaaaugacaggaaaauuaaaccggcuuauagaaaaaaccaaccaacaauuugaguugauagacaaugaauucacugagguagagaagcaaauugguaaugugauaaauuggaccagagacucuauaacagaaguguggucauacaaugcugaacucuugguagcaauggagaaccagcauacaauugaucuggcugauucagaaaugaacaaacuguacgaacgagugaaaagacagcugagagagaaugcugaagaagauggcacugguugcuuugaaauauuucacaaaugugaugaugacuguauggccaguauuagaaauaacaccuaugaucacagcaaauacagggaggaagcaaugcaaaauagaauacagauugacccagucaaacuaagcagcggcuacaaggaugugauacuuugguuuagcuucggggcaucauguuucauacuucuagccauugcaaugggccuugucuucauaugugugaaaaauggaaacaugcggugcacuauuuguauauaa

SEQ ID NO: 40742 - RNA, 1683 nt, Artificial Sequence
  hemagglutinin__InfluenzaA__AGQ81028
augaacacucaaauccuaguauucgcucugauugcgaucauuccaacaaaugcagacaaaaucugccucggacaucaugcugugucaaacggaaccaaaguaaacacauuaacugaaagaggaguggaagucgucaaugcaacugaaacaguggaacgaacaagcauccccaggaucugcucaaaagggaaaagaacaguugaccucggucaauguggacuccuagggacaaucacugggccaccucaaugugaccaauuccuagaauuuucagccgauuuaauuauugagaggcgagaaggaagugaugucuguuauccugggaaauucgugaaugaagaagcucugaggcaaauucucagggaaucaggcggaaucgacaaggaagcaaugggauucacauacagcggaauaagaacuaauggagcaaccagugcauguaggagaucaggaucuucauucuaugcagaaaugaaauggcuccuaucaaacacagauaaugcugcuuucccgccgacgacuaagucauauaaaaauacaagaaaggccccagcucuaauaauaugggggauccaucauuccggaucaacugcagagcaaaccaagcuauaugggaguggaaacaaacuggugacaguuaggaguucuaauuaucaacaaucuuuugugccgaguccaggagcgggaccacaaguuaauggucaaucuggaaggauugacuuucauuggcuaaugcuaaaucccaaugacacagucaccuuuagcuucaauggggcuuucauagcuccagaccgugcaagcuuccugagagggaaaucuaugggaauccagaguggaguacagguugaugccaauugugaaggggacugcuaucauaguggagggacaauaauaaguaauuugccauuucagaacauagacagcagaguaguaggaaaauguccgagauauguuaagcaaaagagucugcugcuagcaacagggaugaagaauguuccugagauuccaaagggaagaggccuauuuggugcuauagcggguuucauugaaaauggaugggaaggccuaauugaugggugguaugguuucagacaccagaaugcacagggagagggaacugcugcagauuacaaaagcacucaaucggcaauuaaucaaaugacaggaaaauuaaaccgacuuauagaaaaaaccaaccaacaauuugaguugauagacaaugaauucacugagguagagaagcagauugguaaugugauaaauuggaccagagacucuauaacagaaauguggucauacaaugcugaacucuugguagcaauggagaaccagcauacaauugaucuggcugauucagaaaugaacaaacuguacgaacgagugaaaagacagcugagagagaaugcugaagaagauggcacugguugcuuugaaauauuucacaaaugugaugaugacuguauggccaguauuagaaauaacaccuaugaucacagcaaauacagggaggaagcaaugcaaaauagaauacagauugacccagucaaacuaagcagcggcuacaaagaugugauacuuugguuuagcuucggggcaucauguuucauacuucuagccauugcaaugggccuugucuucauaugugugaaaaauggaaacaugcggugcacuauuuguauauaa

SEQ ID NO: 40743 - RNA, 1683 nt, Artificial Sequence
  hemagglutinin__InfluenzaA__AGQ81029
augaacacucaaauccuaguauucgcucugauugcgaucauuccaacaaaugcagacaaaaucugccucggacaucaugcugugucaaacggaaccaaaguaaacacauuaacugaaagaggaguggaagucgucaaugcaacugaaacaguggaacgaacaagcauccccaggaucugcucaaaagggaaaagaacaguugaccucggucaauguggacuccuagggacaaucacugggccaccucaaugugaccaauuccuagaauuuucagccgauuuaauuauugagaggcgagaaggaagugaugucuguuauccugggaaauucgugaaugaagaagcucugaggcaaauucucagggagucaggcggaaucgacaaggaagcaaugggauucacauacagcggaauaagaacuaauggaguaaccagugcauguaggagaucaggaucuucauucuaugcagaaaugaaauggcuccuaucaaacacagauaaugcugcuuucccgccgaugacuaagucauauaaaaauacaagaaaggccccagcucuaauaauaugggggauccaucauuccggaucaacugcagagcaaaccaagcuauaugggaguggaaacaaacuggugacaguuaggaguucuaauuaucaacaaucuuuuaugccgaguccaggagcgggaccacaaguuaauggucaaucuggaaggauugacuuucauuggcuaaugcuaaaucccaaugacacagucaccuucagcuucaauggggcuuucauagcuccagaccgugcaagcuuccugagagggaaaucuaugggaauccagaguggaguacagguugaugccaauugugaaggggacugcuaucauaguggagggacaauaauaaguaauuugccauuucagaacauagacagcagaguaguaggaaaauguccgagauauguuaagcaaaagagucugcugcuagcaacagggaugaagaauguuccugagauuccaaagggaagaggccuauuuggugcuauagcggguuucauugaaaauggaugggaaggccuaauugaugggugguaugguuucagacaccagaaugcacagggagagggaacugcugcagauuacaaaagcacucaaucggcaauuaaucaaaugacaggaaaauuaaaccggcuuauagaaaaaaccaaccaacaauuugaguugauagacaaugaauucacugagguagagaagcaaauugguaaugugauaaauuggaccagagacucuauaacagaaguguggucauacaaugcugaacucuugguagcaauggagaaccagcauacaauugaucuggcugauucagaaaugaacaaacuguacgaacgagugaaaagacagcugagagagaaugcugaagaagauggcacugguugcuuugaaauauuucacaaaugugaugaugacuguauggccaguauuagaaauaacaccuaugaucacagcaaauacagggaggaagcaaugcaaaauagaauacagauugacccagucaaacuaagcagcggcuacaaggaugugauacuuugguuuagcuucggggcaucauguuucauacuucuagccauugcaaugggccuugucuucauaugugugaaaaauggaaacaugcggugcacuauuuguauauaa

SEQ ID NO: 40744 - RNA, 1683 nt, Artificial Sequence
  hemagglutinin__InfluenzaA__AGQ81031
augaacacucaaauccuaguauucgcucugauugcgaucauuccaacaaaugcagacaaaaucugccucggacaucaugcugugucaaacggaaccaaaguaaacacauuaacugaaagaggaguggaagucgucaaugcaacugaaacaguggaacgaacaagcauccccaggaucugcucaaaagggaaaagaacaguugaccucggucaauguggacuccuagggacaaucacugggccaccucaaugugaccaauuccuagaauuuucagccgauuuaauuauugagaggcgagaaggaagugaugucuguuauccugggaaauucgugaaugaagaagcucugaggcaaauucucagggaaucaggcggaaucaacaaggaagcaaugggauucacauacagcggaauaagaacuaauggagcaaccagugcauguaggagaucaggaucuucauucuaugcagaaaugaaauggcuccuaucaaacacagauaaugcugcuuucccgccgaugacuaagucauauaaaaauacaagaaaggccccagcucuaauaauaugggggauccaucauuccggaucaacugcagagcaaaccaagcuauaugggaguggaaacaaaauggugacaguuaggaguucuaauuaucaacaaucuuuugugccgaguccaggagcgggaccacaaguuaauggucaaucuggaaggauugacuuucauuggcuaaugcuaaaucccaaugacacagucaccuuuagcuucaauggggcuuucauagcuccagaccgugcaagcuuccugagagggaaaucuaugggaauccagaguggaguacagguugaugccaauugugaaggggacugcuaucauaguggagggacaauaauaaguaauuugccauuucagaacauagacagcagaguaguaggaaaauguccuagauauguuaagcaaaagagucugcugcuagcaacagggaugaagaauguuccugagauuccaaagggaagaggccuauuuggugcuauagcggguuucauugaaaauggaugggaaggccuaauugaugggugguaugguuucagacaccagaaugcacagggagagggaacugcugcagauuacaaaagcacucaaucggcaauuaaucagaugacaggaaaauuaaaccggcuuauagaaaaaaccaaccaacaauuugaguugauagacaaugaauucacugagguagagaggcaaauugguaaugugauaaauuggaccagagacucuauaacagaaguguggucauacaaugcugaacucuugguagcaauggagaaccagcauacaauugaucuggcugauucagaaaugaacaaacuguacgaacgagugaaaagacagcugagagagaaugcugaagaagauggcacugguugcuuugaaauauuucacaaaugugaugaugacuguauggccaguauuagaaauaacaccuaugaucacagcaaauacagggaggaagcaaugcaaaauagaauacagauugacccagucaaacuaagcagcggcuacaaagaugugauacuuugguuuagcuucggggcaucauguuucauacuucuagccauugcaaugggccuugucuucauaugugugaaaaauggaaacaugcggugcacuauuuguauauaa

SEQ ID NO: 40745 - RNA, 1683 nt, Artificial Sequence
  hemagglutinin__InfluenzaA__AGQ81032
augaacacucaaauccuaguauucgcucugauugcgaucauuccaacaaaugcagacaaaaucugccucggacaucaugcugugucaaacggaaccaaaguaaacacauuaacugaaagaggaguggaagucgucaaugcaacugaaacaguggaacgaacaagcauccccaggaucugcucaaaagggaaaagaacaguugaccucggucaauguggacuccuagggacaaucacugggccaccucaaugugaucaauuccuagaauuuucagccgauuuaauuauugagaggcgagaaggaagugaugucuguuauccugggaaauucgugaaugaagaagcucugaggcaaauucucagggaaucaggcggaaucgacaaggaagcaaugggauucacauacagcggaauaagaacuaauggagcaaccagugcauguaggagaucaggaucuucauucuaugcagaaaugaaauggcuccuaucaaacacagauaaugcugcuuucccgccgacgacuaagucauauaaaaauacaagaaaggccccagcucuaauaauaugggggauccaucauuccggaucaacugcagagcaaaccaagcuauaugggaguggaaacaaacuggugacaguuaggaguucuaauuaucaacaaucuuuugugccgaguccaggagcgggaccacaaguuaauggucaaucuggaaggauugacuuucauuggcuaaugcuaaaucccaaugacacagucaccuuuagcuucaauggggcuuucauagcuccagaccgugcaagcuuccugagagggaaaucuaugggaauccagaguggaguacagguugaugccaauugugaaggggacugcuaucauaguggagggacaauaauaaguaauuugccauuucagaacauagacagcagaguaguaggaaaauguccgagauauguuaagcaaaagagucugcugcuagcaacagggaugaagaauguuccugagauuccaaagggaagaggccuauuuggugcuauagcggguuucauugaaaauggaugggaaggccuaauugaugggugguaugguuucagacaccagaaugcacagggagagggaacugcugcagauuacaaaagcacucaaucggcaauuaaucaaaugacaggaaaauuaaaccgacuuauagaaaaaaccaaccaacaauuugaguugauagacaaugaauucacugagguagagaagcaaauugguaaugugauaaauuggaccagagacucuauaacagaaguguggucauacaaugcugaacucuugguagcaauggagaaccagcauacaauugaucuggcugauucagaaaugaacaaacuguacgaacgagugaaaagacagcugagagagaaugcugaagaagauggcacugguugcuuugaaauauuucacaaaugugaugaugacuguauggccaguauuagaaauaacaccuaugaucacagcaaauacagggaggaagcaaugcaaaauagaauacagauugacccagucaaacuaagcagcggcuacaaagaugugauacuuugguuuagcuucggggcaucauguuucauacuucuagccauugcaaugggccuugucuucauaugugugaaaaauggaaacaugcggugcacuauuuguauauaa

SEQ ID NO: 40746 - RNA, 1683 nt, Artificial Sequence
  hemagglutinin__InfluenzaA__AGQ81033
augaacacucaaauccuaguauucgcucugauugcgaucauuccaacaaaugcagacaaaaucugccucggacaucaugcugugucaaacggaaccaaaguaaacacauuaaccgaaagaggaguggaagucgucaaugcaacugaaacaguggaacgaacaagcauccccaggaucugcucaaaagggaaaagaacaguugaccucggucaauguggacuccuagggacaaucacugggccaccucaaugugaccaauuccuagaauuuucagccgauuuaauuauugagaggcgagaaggaagugaugucuguuauccugggaaauucgugaaugaagaagcucugaggcaaauucucagggagucaggcggaaucgacaaggaagcaaugggauucacauacagcggaauaagaacuaauggaguaaccagugcauguaggagaucaggaucuucauucuaugcagaaaugaaauggcuccuaucaaacacagauaaugcugcuuucccgccgaugacuaagucauauaaaaauacaagaaaggccccagcucuaauaauaugggggauccaucauuccggaucaacugcagagcaaaccaagcuauaugggaguggaaacaaacuggugacaguuaggaguucuaauuaucaacaaucuuuugugccgaguccaggagcgggaccacaaguuaauggucaaucuggaaggauugacuuucauuggcuaaugcuaaaucccaaugacacagucaccuucagcuucaauggggcuuucauagcuccagaccgugcaagcuuccugagagggaaaucuaugggaauccagaguggaguacagguugaugccaauugugaaggggacugcuaucauaguggagggacaauaauaaguaauuugccauuucagaacauagacagcagaguaguaggaaaauguccgagauauguuaagcaaaagagucugcugcuagcaacagggaugaagaauguuccugagauuccaaagggaagaggccuauuuggugcuauagcggguuucauugaaaauggaugggaaggccuaauugaugggugguaugguuucagacaccagaaugcacagggagagggaacugcugcagauuacaaaagcacucaaucggcaauuaaucaaaugacaggaaaauuaaaccggcuuauagaaaaaaccaaccaacaauuugaguugauagacaaugaauucacugagguagagaagcaaauugguaaugugauaaauuggaccagagacucuauaacagaaguguggucauacaaugcugaacucuugguagcaauggagaaccagcauacaauugaucuggcugauucagaaaugaacaaacuguacgaacgagugaaaagacagcugagagagaaugcugaagaagauggcacugguugcuuugaaauauuucacaaaugugaugaugacuguauggccaguauuagaaauaacaccuaugaucacagcaaauacagggaggaagcaaugcaaaauagaauacagauugacccagucaaacuaagcagcggcuacaaggaugugauacuuugguuuagcuucggggcaucauguuucauacuucuggccauugcaaugggccuugucuucauaugugugaaaaauggaaacaugcggugcacuauuuguauauaa

SEQ ID NO: 40747 - RNA, 1683 nt, Artificial Sequence
  hemagglutinin__InfluenzaA__AGQ81034
augaacacucaaauccuaguauucgcucugauugcgaucauuccaacaaaugcagacaaaaucugccucggacaucaugcugugucaaacggaaccaaaguaaacacauuaacugaaagaggaguggaagucgucaaugcaacugaaacaguggaacgaacaagcauccccaggaucugcucaaaagggaaaagaacaguugaccucggucaauguggacuccuagggacaaucacugggccaccucaaugugaccaauuccuagaauuuucagccgauuuaauuauugagaggcgagaaggaagugaugucuguuauccugggaaauucgugaaugaagaagcucugaggcaaauucucagggaaucaggcggaaucgacaaggaagcaaugggauucacauacagcggaauaagaacuaauggagcgaccagugcauguaggagaucaggaucuucauucuaugcagaaaugaaauggcuccuaucaaacacagauaaugcugcuuucccgccgacgacuaagucauauaaaaauacaagaaaggccccagcucuaauaauaugggggauccaucauuccggaucaacugcagagcaaaccaagcuauaugggaguggaaacaaacuggugacaguuaggaguucuaauuaucaacaaucuuuugugccgaguccaggagcgggaccacaaguuaauggucaaucuggaaggauugacuuucauuggcuaaugcuaaaucccaaugacacagucaccuuuagcuucaauggggcuuucauagcuccagaccgugcaagcuuccugagggggaaaucuaugggaauccagaguggaguacagguugaugccaauugugaaggggacugcuaucauaguggagggacaauaauaaguaauuugccauuucagaacauagacagcagaguaguaggaaaaugcccgagauauguuaagcaaaagagucugcugcuagcaacagggaugaagaauguuccugagauuccaaagggaagaggccuauuuggugcuauagcggguuucauugaaaauggaugggaaggccuaauugaugggugguaugguuucagacaccagaaugcacagggagagggaacugcugcagauuacaaaagcacucaaucggcaauuaaucaaaugacaggaaaauuaaaccggcuuauagaaaaaaccaaccaacaauuugaguugauagacaaugaauucacugaaguagagaagcaaauugguaaugugauaaauuggaccagagacucuauaacagaaguguggucauacaaugcugaacucuugguagcaauggagaaccagcauacaauugaucuggcugauucagaaaugaacaaacuguacgaacgagugaaaagacagcugagagagaaugcugaagaagauggcacugguugcuuugaaauauuucacaaaugugaugaugacuguauggccaguauuagaaauaacaccuaugaucacagcaaauacagggaggaagcaaugcaaaauagaauacagauugacccagucaaacuaagcagcggcuacaaagaugugauacuuugguuuagcuucggggcaucauguuucauacuucuagccauugcaaugggccuugucuucauaugugugaaaaauggaaacaugcggugcacuauuuguauauaa

SEQ ID NO: 40748 - RNA, 1683 nt, Artificial Sequence; identical to SEQ ID NO: 40746
  hemagglutinin__InfluenzaA__AGQ81035

SEQ ID NO: 40749 - RNA, 1683 nt, Artificial Sequence; identical to SEQ ID NO: 40746
  hemagglutinin__InfluenzaA__AGQ81036

SEQ ID NO: 40750 - RNA, 1683 nt, Artificial Sequence; identical to SEQ ID NO: 40746
  hemagglutinin__InfluenzaA__AGQ81037

SEQ ID NO: 40751 - RNA, 1683 nt, Artificial Sequence; identical to SEQ ID NO: 40736
  hemagglutinin__InfluenzaA__AGQ81038

SEQ ID NO: 40752 - RNA, 1683 nt, Artificial Sequence; identical to SEQ ID NO: 40733
  hemagglutinin__InfluenzaA__AGQ81039

SEQ ID NO: 40753 - RNA, 1683 nt, Artificial Sequence
  hemagglutinin__InfluenzaA__AGQ81040
augaacacucaaauccugguauucgcucugauugcgaucauuccaacaaaugcagacaaaaucugccucggacaucaugcugugucaaacggaaccaaaguaaacacauuaacugaaagaggaguggaagucgucaaugcaacugaaacaguggaacgaacaaacauccccaggaucugcucaaaagggaaaagaacaguugaccucggucaauguggacuccuggggacaaucacugggccaccucaaugugaccaauuccuagaauuuucagccgauuuaauuauugagagacgagaaggaagugaugucuguuauccugggaaauucgugaaugaagaagcucugaggcaaauucucagggaaucaggcggaaucgacaaggaagcaaugggauucacauacagcggaauaagaacuaauggagcaaccagugcauguaggagaucaggaucuucauucuaugcagaaaugaaauggcuccuaucaaacacagauaaugcugcuuucccgcagaugacuaagucauauaaaaauacaagaaaggacccagcucuaauaauaugggggauccaucauuccggaucaacugcagagcaaaccaagcuauaugggaguggaaacaaacuggugacaguugggaguucuaauuaucaacaaucuuuugugccgaguccaggagcgagaccacaaguuaauggucaaucuggaaggauugacuuucauuggcuaaugcuaaaucccaaugacacagucaccuucagcuucaauggggcuuucauagcuccagaccgugcaagcuuccugagagggaaaucuaugggaauccagaguggaguacagauugaugccaauugugaaggggacugcuaucauaguggagggacaauaauaaguaacuugccauuucagaacauagacagcagagcaguaggaaaauguccgagauauguuaagcaaaagagccugcugcuagcaacagggaugaagaauguuccugagauuccaaagggaagaggccuauuuggugcuauagcggguuucauugaaaauggaugggaaggccuaauugaugggugguaugguuucagacaccagaaugcacagggagagggaacugcugcagacuacaaaagcacucaaucggcaauugaucaaauaacaggaaaauuaaaccggcuuauagaaaaaaccaaccaacaauuugaguugauagacaaugaauucacugagguagagaagcagaucgguaaugugauaaauuggaccagagacucuauaacggaaguguggucauacaaugcugagcucuugguagcaauggagaaccagcauacaauugaucuggcugauucagaaaugaacaaacuguacgaacgagugaaaagacagcugagagaaaaugcugaagaagauggcacugguugcuuugaaauauuucacaaaugugaugaugacuguauggccaguauuagaaauaacaccuaugaucacagcaaauacagggaagaagcaaugcaaaauagaauacagauugacccagucaaacuaagcagcggcuacaaagaugugauacuuugguuuagcuucggggcaucauguuucauacuucuagccauugcaaugggccuugucuucauaugugugaagaauggaaacaugcggugcacuauuuguauauaa

SEQ ID NO: 40754 - RNA, 1683 nt, Artificial Sequence
  hemagglutinin__InfluenzaA__AGQ81041
augaacacucaaauccugguauucgcucugauugcgaucauuccaacaaaugcagacaaaaucugccucggacaucaugcugugucaaacggaaccaaaguaaacacauuaacugaaagaggaguggaagucgucaaugcaacugaaacaguggaacgaacaaacauccccaggaucugcucaaaagggaaaagaacaguugaccucggucaauguggacuccuggggacaaucacugggccaccucaaugugaccaauuccuagaauuuucagccgauuuaauuauugagagacgagaaggaagugaugucuguuauccugggaaauucgugaaugaagaagcucugaggcaaauucucagggaaucaggcggaauugacaaggaagcaaugggauucacauacagcggaauaagaacuaauggagcaaccagugcauguaggagaucaggaucuucauucuaugcagaaaugaaauggcuccuaucaaacacagauaaugcugcuuucccgcagacgacuaagucauauaaaaauacaagaaaggacccagcucuaauaauaugggggauccaucauuccggaucaacugcagagcaaaccaagcuauaugggaguggaaacaaacuggugacaguugggaguucuaauuaucaacaaucuuuugugccgaguccaggagcgagaccacaaguuaauggucaaucuggaaggauugacuuucauuggcuaaugcuaaaucccaaugacacagucaccuucagcuucaauggggcuuucauagcuccagaccgugcaagcuuccugagagggaaaucuaugggaauccagaguggaguacagguugaugccaauugugaaggggacugcuaucauaguggagggacaauaauaaguaacuugccauuucagaacauagacagcagagcaguaggaaaauguccgagauauguuaagcaaaagagucugcugcuagcaacagggaugaagaauguuccugagauuccaaagggaagaggccuauuuggugcuauagcggguuucauugaaaauggaugggaaggccuaauugaugggugguauggcuucagacaccagaaugcacagggagagggaacugcugcagacuacaaaagcacccaaucggcaauugaucaaauaacaggaaaauuaaaccggcuuauagaaaaaaccaaccaacaauuugaguugauagacaaugaauucacugagguagagaagcaaaucgguaaugugauaaauuggaccagagacucuauaacggaaguguggucauacaaugcugagcucuugguagcaauggagaaccagcauacaauugaucuggcugauucagaaaugaacaaacuguacgaacgagugaaaagacagcugagagagaaugcugaagaagauggcacugguugcuuugaaauauuucacaaaugugaugaugacuguauggccaguauuagaaauaacaccuaugaucacagcaaauacagggaagaagcaaugcaaaauagaauacagauugacccagucaaauuaagcagcggcuacaaagaugugauacuuugguuuagcuucggggcaucauguuucauacuucuagccauugcaaugggccuugucuucauaugugugaagaauggaaacaugcggugcacuauuuguauauaa

SEQ ID NO: 40755 - RNA, 1683 nt, Artificial Sequence
  hemagglutinin__InfluenzaA__AGQ81042
augaacacucaaauccugguauucgcucugauugcgaucauuccaacaaaugcagacaaaaucugccucggacaucaugcugugucaaacggaaccaaaguaaacacauuaacugaaagaggaguggaagucgucaaugcaacugaaacaguggaacgaacaaacauccccaggaucugcucaaaagggaaaagaacaguugaccucggucaauguggacuccuggggacaaucacugggccaccucaaugugaccaauuccuagaauuuucagccgauuuaauuauugagagacgagaaggaagugaugucuguuauccugggaaauucgugaaugaagaagcucugaggcaaauucucagggaaucaggcggaauugacaaggaagcaaugggauucacauacagcggaauaagaacuaauggagcaaccagugcauguaggagaucaggaucuucauucuaugcagaaaugaaauggcuccuaucaaacacagauaaugcugcuuucccgcagaugacuaagucauauaaaaauacaagaaaggacccagcucuaauaauaugggggauccaucauuccggaucaacugcagagcaaaccaagcuauaugggaguggaaacaaacuggugacaguugggaguucuaauuaucaacaaucuuuugugccgaguccaggagcgagaccacaaguuaauggucaaucuggaaggauugacuuucauuggcuaaugcuaaaucccaaugacacagucaccuucagcuucaauggggcuuucauagcuccagaccgugcaagcuuccugagagggaaaucuaugggaauccagaguggaguacagguugaugccaauugugaaggggacugcuaucauaguggagggacaauaauaaguaacuugccauuucagaacauagacagcagagcaguaggaaaauguccgagauauguuaagcaaaagagucugcugcuagcaacagggaugaagaauguuccugagauuccaaagggaagaggccuauuuggugcuauagcggguuucauugaaaauggaugggaaggccuaauugaugggugguauggcuucagacaccagaaugcacagggagagggaacugcugcagacuacaaaagcacucaaucggcaauugaucaaauaacaggaaaauuaaaccggcuuauagaaaaaaccaaccaacaauuugaguugauagacaaugaauucacugagguagagaagcaaaucgguaaugugauaaauuggaccagagacucuauaacggaaguguggucauacaaugcugagcucuugguagcaauggagaaccagcauacaauugaucuggcugauucagaaaugaacaaacuguacgaacgagugaaaagacagcugagagagaaugcugaagaagauggcacugguugcuuugaaauauuucacaaaugugaugaugacuguauggccaguauuagaaauaacaccuaugaucacagcaaauacagggaagaagcaaugcaaaauagaauacagauugacccagucaaauuaagcagcggcuacaaagaugugauacuuugguuuagcuucggggcaucauguuucauacuucuagccauugcaaugggccuugucuucauaugugugaagaauggaaacaugcggugcacuauuuguauauaa

SEQ ID NO: 40756 - RNA, 1683 nt, Artificial Sequence
  hemagglutinin__InfluenzaA__AGQ81043
augaacacucaaauccugguauucgcucugauugcgaucauuccaacaaaugcagacaaaaucugccucggacaucaugccgugucaaacggaaccaaaguaaacacauuaacugaaagaggaguggaagucgucaaugcaacugaaacaguggaacgaacaaacauccccaggaucugcucaaaagggaaaaggacaguugaccucggucaauguggacuccuggggacaaucacuggaccaccucaaugugaccaauuccuagaauuuucagccgauuuaauuauugagaggcgagaaggaagugaugucuguuauccugggaaauucgugaaugaagaagcucugaggcaaauucucagagaaucaggcggaauugacaaggaagaaaugggauucacauacaguggaauaagaacuaauggagcaaccagugcauguaggagaucaggaucuucauucuaugcagaaaugaaauggcuccugucaaacacagauaaugcugcauucccgcagaugacuaagucauauaaaaauacaagaaaaagcccagcucuaauaguaugggggauccaucauuccguaucaacugcagagcaaaccaagcuauaugggaguggaaacaaacuggugacaguugggaguucuaauuaucaacaaucuuuuguaccgaguccaggagcgagaccacaaguuaauggucuaucuggaagaauugacuuucauuggcuaaugcuaaaucccaaugauacagucacuuucaguuucaauggggcuuucauagcuccagaccgugcaagcuuccugagaggaaaaucuaugggaauccagaguggaguacagguugaugccaauugugaaggggacugcuaucauaguggagggacaauaauaaguaacuugccauuucagaacauagauagcagggcaguuggaaaauguccgagauauguuaagcaaaggagucugcugcuagcaacagggaugaagaauguuccugagauuccaaagggaagaggccuauuuggugcuauagcggguuucauugaaaaugggugggaaggccuaauugaugguugguaugguuucagacaccagaaugcacagggagagggaacugcugcagauuacaaaagcacucaaucggcaauugaucaaauaacaggaaaauuaaaccggcuuauagaaaaaaccaaccaacaauuugaguugauagacaaugaauucaaugagguagagaagcaaaucgguaaugugauaaauuggaccagagauucuauaacagaaguguggucauacaaugcugaacucuugguagcaauggagaaccagcauacaauugaucuggcugauucagaaauggacaaacuguacgaacgagugaaaagacagcugagagagaaugcugaagaagauggcacugguugcuuugaaauauuucacaagugugaugaugacuguauggccaguauuagaaauaacaccuaugaucacagcaaauacagggaagaggcaaugcaaaauagaauacagauugacccagucaaacuaagcagcggcuacaaagaugugauacuuugguuuagcuucggggcaucauguuucauacuucuagccauuguaaugggccuugucuucauauguguaaagaauggaaacaugcggugcacuauuuguauauaa

SEQ ID NO: 40757 - RNA, 1683 nt, Artificial Sequence
  hemagglutinin__InfluenzaA__AGQ81044
augaacacucaaauccugguauucgcucugauugcgaucauuccaacaaaugcagacaaaaucugccucggacaucaugccgugucaaacggaaccaaaguaaacacauuaacugaaagaggaguggaagucgucaaugcaacugaaacaguggaacgaacaaacauccccaggaucugcucaaaagggaaaaggacaguugaccucggucaauguggacuccuggggacaaucacuggaccaccucaaugugaccaauuccuagaauuuucagccgauuuaauuauugagaggcgagaaggaagugaugucuguuauccugggaaauucgugaaugaagaagcucugaggcaaauucucagagaaucaggcggaauugacaaggaagcaaugggauucacauacaguggaauaagaacuaauggagcaaccagugcauguaggagaucaggaucuucauucuaugcagaaaugaaauggcuccugucaaacacagauaaugcugcauucccgcagaugacuaagucauauaaaaauacaagaaaaagcccagcucuaauaguaugggggauccaucauuccguaucaacugcagagcaaaccaagcuauaugggaguggaaacaaacuggugacaguugggaguucuaauuaucaacaaucuuuuguaccgaguccaggagcgagaccacaaguuaauggucuaucuggaagaauugacuuucauuggcuaaugcuaaaucccaaugauacagucacuuucaguuucaauggggcuuucauagcuccagaccgugcaagcuuccugagaggaaaaucuaugggaauccagaguggaguacagguugaugccaauugugaaggggacugcuaucauaguggagggacaauaauaaguaacuugccauuucagaacauagauagcagggcaguuggaaaauguccgagauauguuaagcaaaggagucugcugcuagcaacagggaugaagaauguuccugagauuccaaagggaagaggccuauuuggugcuauagcggguuucauugaaaaugggugggaaggccuaauugaugguugguaugguuucagacaccagaaugcacagggagagggaacugcugcagauuacaaaagcacucaaucggcaauugaucaaauaacaggaaaauuaaaccggcuuauagaaaaaaccaaccaacaauuugaguugauagacaaugaauucaaugagguagagaagcaaaucgguaaugugauaaauuggaccagagauucuauaacagaaguguggucauacaaugcugaacucuugguagcaauggagaaccagcauacaauugaucuggcugauucagaaauggacaaacuguacgaacgagugaaaagacagcugagagagaaugcugaagaagauggcacugguugcuuugaaauauuucacaagugugaugaugacuguauggccaguauuagaaauaacaccuaugaucacagcaaauacagggaagaggcaaugcaaaauagaauacagauugacccagucaaacuaagcagcggcuacaaagaugugauacuuugguuuagcuucggggcaucauguuucauacuucuagccauuguaaugggccuugucuucauauguguaaagaauggaaacaugcggugcacuauuuguauauaa

SEQ ID NO: 40758 - RNA, 1683 nt, Artificial Sequence; identical to SEQ ID NO: 40757
  hemagglutinin__InfluenzaA__AGQ81045

SEQ ID NO: 40759 - RNA, 1683 nt, Artificial Sequence; identical to SEQ ID NO: 40757
  hemagglutinin__InfluenzaA__AGQ81046

SEQ ID NO: 40760 - RNA, 1683 nt, Artificial Sequence; identical to SEQ ID NO: 40746
  hemagglutinin__InfluenzaA__AGQ81047

SEQ ID NO: 40761 - RNA, 1683 nt, Artificial Sequence
  hemagglutinin__InfluenzaA__AGQ81049
augaacacucaaauccuaguauucgcucugauugcgaucauuccaacaaaugcagacaaaaucugccucggacaucaugcugugucaaacggaaccaaaguaaacacauuaacugaaagaggaguggaagucgucaaugcaacugaaacaguggaacgaacaagcauccccaggaucugcucaaaagggaaaagaacaguugaccucggucaauguggacuccuagggacaaucacugggccaccucaaugugaccaauuccuagaauuuucagccgauuuaauuauugagaggcgagaaggaagugaugucuguuauccugggaaauucgugaaugaagaagcucugaggcaaauucucagggaaucaggcggaaucgacaaggaagcaaugggauucacauacagcggaauaagaacuaauggagcaaccagugcauguaggagaucaggaucuucauucuaugcagaaaugaaauggcuccuaucaaacacagauaaugcugcuuucccgccgacgacuaagucauauaaaaauacaagaaaggccccagcucuaauaauaugggggauccaucauuccggaucaacugcagagcaaaccaagcuauaugggaguggaaacaaacuggugacaguuaggaguucuaauuaucaacaaucuuuugugccgaguccaggagcgggaccacaaguuaauggucaaucuggaaggauugacuuucauuggcuaaugcuaaaucccaaugacacagucaccuuuagcuucaauggggcuuucauagcuccagaccgugcaagcuuccugagagggaaaucuaugggaauccagaguggaguacagguugaugccaauugugaaggggacugcuaucauaguggagggacaauaauaaguaauuugccauuucagaacauagacagcagaguaguaggaaaaugcccgagauauguuaagcaaaagagucugcugcuagcaacagggaugaagaauguuccugagauuccaaagggaagaggccuauuuggugcuauagcggguuucauugaaaauggaugggaaggccuaauugaugggugguaugguuucagacaccagaaugcacagggagagggaacugcugcagauuacaaaagcacucaaucggcaauuaaucaaaugacaggaaaauuaaaccggcuuauagaaaaaaccaaccaacaauuugaguugauagacaaugaauucacugagguagagaagcaaauugguaaugugauaaauuggaccagagacucuauaacagaaguguggucauacaaugcugaacucuugguagcaauggagaaccagcauacaauugaucuggcugauucagaaaugaacaaacuguacgaacgagugaaaagacaacugagagagaaugcugaagaagauggcacugguugcuuugaaauauuucacaaaugugaugaugacuguauggccaguauuagaaauaacaccuaugaucacagcaaauacagggaggaagcaaugcaaaauagaauacagauugacccagucaaacuaagcagcggcuacaaagaugugauacuuugguuuagcuucggggcaucauguuucauacuucuagccauugcaaugggccuugucuucauaugugugaaaaauggaaacaugcggugcacuauuuguauauaa

SEQ ID NO: 40762 - RNA, 1683 nt, Artificial Sequence; identical to SEQ ID NO: 40746
  hemagglutinin__InfluenzaA__AGQ81050

SEQ ID NO: 40763 - RNA, 1683 nt, Artificial Sequence
  hemagglutinin__InfluenzaA__AGQ81051
augaacacucaaauccuaguauucgcucugauugcgaucauuccaacaaaugcagacaaaaucugccucggacaucaugcugugucaaacggaaccaaaguaaacacauuaacugaaagaggaguggaagucgucaaugcaacugaaacaguggaacgaacaagcauccccaggaucugcucaaaagggaaaagaacaguugaccucggucaauguggacuccuagggacaaucacugggccaccucaaugugaccaauuccuagaauuuucagccgauuuaauuauugagaggcgagaaggaagugaugucuguuauccugggaaauucgugaaugaagaagcucugaggcaaauucucagggaaucaggcggaaucaacaaggaagcaaugggauucacauacagcggaauaagaacuaauggagcaaccagugcauguaggagaucaggaucuucauucuaugcagaaaugaaauggcuccuaucaaacacagauaaugcugcuuucccgccgaugacuaagucauauaaaaauacaagaaaggccccagcucuaauaauaugggggauccaucauuccggaucaacugcagagcaaaccaagcuauaugggaguggaaacaaacuggugacaguuaggaguucuaauuaucaacaaucuuuugugccgaguccaggagcgggaccacaaguuaauggucaaucuggaaggauugacuuucauuggcuaaugcuaaaucccaaugacacagucaccuucagcuucaauggggcuuucauagcuccagaccgugcaagcuuccugagagggaaaucuaugggaauccagaguggaguacagguugaugccaauugugaaggggacugcuaucauaguggagggacaauaauaaguaauuugccauuucagaacauagacagcagaguaguaggaaaauguccgagauauguuaagcaaaagagucugcugcuagcaacagggaugaagaauguuccugagauuccaaagggaagaggccuauuuggugcuauagcggguuucauugaaaauggaugggaaggccuaauugaugggugguaugguuucagacaccagaaugcacagggagagggaacugcugcagauuacaaaagcacucaaucggcaauuaaucagaugacaggaaaauuaaaccggcuuauagaaaaaaccaaccaacaauuugaguugauagacaaugaauucacugagguagagaagcaaauugguaaugugauaaauuggaccagagacucuauaacagaaguguggucauacaaugcugaacucuugguagcaauggagaaccagcauacaauugaucuggcugauucagaaaugaacaaacuguacgaacgagugaaaagacagcugagagagaaugcugaagaagauggcacugguugcuuugaaauauuucacaaaugugaugaugacuguauggccaguauuagaaauaacaccuaugaucacagcaaauacagggaggaagcaaugcaaaauagaauacagauugacccagucaaacuaagcagcggcuacaaggaugugauacuuugguuuagcuucggggcaucauguuucauacuucuggccauugcaaugggccuugucuucauaugugugaaaaauggaaacaugcggugcacuauuuguauauaa

SEQ ID NO: 40764 - RNA, 1683 nt, Artificial Sequence; identical to SEQ ID NO: 40746
  hemagglutinin__InfluenzaA__AGQ81052

SEQ ID NO: 40765 - RNA, 1683 nt, Artificial Sequence
  hemagglutinin__InfluenzaA__AGQ81053
augaacacucaaauccuaguauucgcucugauugcgaucauuccaacaaaugcagacaaaaucugccucggacaucaugcugugucaaacggaaccaaaguaaacacauuaacugaaagaggaguggaagucgucaaugcaacugaaacaguggaacgaacaagcauccccaggaucugcucaaaagggaaaagaacaguugaccucggucaauguggacuccuagggacaaucacugggccaccucaaugugaccaauuccuagaauuuucagccgauuuaauuauugagaggcgagaaggaagugaugucuguuauccugggaaauucgugaaugaagaagcucugaggcaaauucucagggaaucaggcggaaucaacaaggaagcaaugggauucacauacagcggaauaagaacuaauggagcaaccagugcauguaggagaucaggaucuucauucuaugcagaaaugaaauggcuccuaucaaacacagauaaugcugcuuucccgccgaugacuaagucauauaaaaauacaagaaaggccccagcucuaauaauaugggggauccaucauuccggaucaacugcagagcaaaccaagcuauaugggaguggaaacaaaauggugacaguuaggaguucuaauuaucaacaaucuuuugugccgaguccaggagcgggaccacaaguuaauggucaaucuggaaggauugacuuucauuggcuaaugcuaaaucccaaugacacagucaccuuuagcuucaauggggcuuucauagcuccagaccgugcaagcuuccugagagggaaaucuaugggaauccagaguggaguacagguugaugccaauugugaaggggacugcuaucauaguggagggacaauaauaaguaauuugccauuucagaacauagacagcagaguaguaggaaaauguccgagauauguuaagcaaaagagucugcugcuagcaacagggaugaagaauguuccugagauuccaaagggaagaggccuauuuggugcuauagcggguuucauugaaaauggaugggaaggccuaauugaugggugguaugguuucagacaccagaaugcacagggagagggaacugcugcagauuacaaaagcacucaaucggcaauuaaucagaugacaggaaaauuaaaccggcuuauagaaaaaaccaaccaacaauuugaguugauagacaaugaauucacugagguagagaagcaaauugguaaugugauaaauuggaccagagacucuauaacagaaguguggucauacaaugcugaacucuugguagcaauggagaaccagcauacaauugaucuggcugauucagaaaugaacaaacuguacgaacgagugaaaagacagcugagagagaaugcugaagaagauggcacugguugcuuugaaauauuucacaaaugugaugaugacuguauggccaguauuagaaauaacaccuaugaucacagcaaauacaggaaggaagcaaugcaaaauagaauacagauugacccagucaaacuaagcagcggcuacaaagaugugauacuuugguuuagcuucggggcaucauguuucauacuucuagccauugcaaugggccuugucuucauaugugugaaaaauggaaacaugcggugcacuauuuguauauaa

SEQ ID NO: 40766 - RNA, 1683 nt, Artificial Sequence; identical to SEQ ID NO: 40741
  hemagglutinin__InfluenzaA__AGQ81055

SEQ ID NO: 40767 - RNA, 1683 nt, Artificial Sequence; identical to SEQ ID NO: 40741
  hemagglutinin__InfluenzaA__AGQ81056

SEQ ID NO: 40768 - RNA, 1683 nt, Artificial Sequence; identical to SEQ ID NO: 40741
  hemagglutinin__InfluenzaA__AGQ81057

SEQ ID NO: 40769 - RNA, 1683 nt, Artificial Sequence; identical to SEQ ID NO: 40741
  hemagglutinin__InfluenzaA__AGQ81058

SEQ ID NO: 40770 - RNA, 1683 nt, Artificial Sequence; identical to SEQ ID NO: 40757
  hemagglutinin__InfluenzaA__AGQ81059

SEQ ID NO: 40771 - RNA, 1683 nt, Artificial Sequence; identical to SEQ ID NO: 40757
  hemagglutinin__InfluenzaA__AGQ81060

SEQ ID NO: 40772 - RNA, 1683 nt, Artificial Sequence; identical to SEQ ID NO: 40757
  hemagglutinin__InfluenzaA__AGQ81061

SEQ ID NO: 40773 - RNA, 1683 nt, Artificial Sequence
  hemagglutinin__InfluenzaA__AGQ81081
auggaaguaguaucacuaauaacuauacuacuaguaauaacaggaagcaaugcggauaaaaucugcauuggcuaccaaucaacaaacuccaccgaaacuguagacacgcuaaccgaaaacaauguuccugugacacaugccaaagaauugcuucacacagaacacaaugggaugcuaugugcaacaaaucugggacguccucuuauucuagacaccuguaccauugaaggacuaaucuauggcaacccuucuugugauauacugcugggaggaagagaaugguccuauauugucgaaagaccaucggcuguuaauggacuguguuaccccggaaacguagaaaaccuagaagaauuaaggucacuuuuuagcucugcuaguucuuaccaaagaauccagaucuuuccagacacaaucuggaaugugucuuacaguggaacaagcaaagcauguucagauucauucuacagaagcaugaggugguugacucaaaagaacaaugcuuacccuguucaagacgcccaauacacaaauaauagaggaaggaacauucuuuucauguggggcauaaaucacccacccacugauacugcgcagacaaaucuguacacaaggacugacacaacaacaaguguggcgacagaagauauaaauaggaccuucaaaccauugauagggccaaggccucuugucaauggucugcaaggaaggauugacuauuauugggcgguguugagaccaggucagacauugcgaauaagauccaacgggaaucuaaucgcuccaugguauggacacauucuuucaggggagagucacggaagaauccugaaaacggauuuaaacagugguaacuguguagugcaaugucaaacagaaagagguggcuugaauacuacauugccauuccacaacguaagcaaguacgcauuuggaaauugcccaaaauauguuggaguaaagagucucaaauuggcagucggucugaggaaugugccugcuagaucaaguagagggcuauuuggagccauagcugguuucauagaaggagguuggucaggauugguugcugguugguauggguuccagcauucaaaugaucaaggaacugguauggcugcagauagagacucgacucaaaaggcaauugacaaaauaacguccaaaguaaauaauauagucgauaaaaugaacaaacaguaugaaauuauugaucaugaauucagcgagauugaaacuagacucaauaugaucaauaauaagauugaugaucaaauucaagacauaugggcauauaacgcugaauugcuaguacugcuugaaaaucagaaaacgcucgaugagcaugaugcaaauguaaacaaucuguauaacaaagugaagagggcacuggguuccaaugcaguggaagaugggaaaggaugcuucgagcuauaccauaaaugcgauaaccagugcauggagacaauucgaaacgggaccuauaacagaagaaaguauaaagaggaaucaagacuagagagacagaaaauagagggggucaaacuggaaucugaaggaaccuacaaaauccucaccauuuauucgacugucgccucaucucuuguuauugcaaugggguucgcugccuucuuguucugggccauguccaauggaucuugcagaugcaacauuuguauauga

SEQ ID NO: 40774 - RNA, 1683 nt, Artificial Sequence
  hemagglutinin__InfluenzaA__AGQ81086
auggaaguaguaucacuaauaacuauacuacuaguaauaacaggaagcaaugcggauaaaaucugcauuggcuaccaaucaacaaacuccaccgaaacuguagacacgcuaaccgaaaacaauguuccugugacacaugccaaagaauugcuucacacagaacacaaugggaugcuaugugcaacaaaucugggacguccucuuauucuagacaccuguaccauugaaggacuaaucuauggcaacccuucuugugaucuacugcugggaggaagagaaugguccuauauugucgaaagaccaucggcuguuaauggacuguguuaccccggaaacguagaaaaccuagaagaauuaaggucacuuuuuagcucugcuaguucuuaccaaagaauccagaucuuuccagacacaaucuggaaugugucuuacaguggaacaagcaaagcauguucagauucauucuacagaagcaugaggugguugacucaaaagaacaaugcuuacccuguucaagacgcccaauacacaaauaauagaggaaggaacauucuuuucauguggggcauaaaucacccacccacugauacugcgcagacaaaucuguacacaaggacugacacaacaacaaguguggcgacagaagauauaaauaggaccuucaaaccauugauagggccaaggccucuugucaauggucugcaaggaaggauugacuauuauugggcgguguugagaccaggucagacauugcgaauaagauccaacgggaaucuaaucgcuccaugguauggacacauucuuucaggggagagucacggaagaauccugaaaacggauuuaaacagugguaacuguguagugcaaugucaaacagaaagagguggcuugaauacuacauugccauuccacaacguaagcaaguacgcauuuggaaauugcccaaaauauguuggaguaaagagucucaaauuggcagucggucugaggaaugugccugcuagaucaaguagagggcuauuuggagccauagcugguuucauagaaggagguuggucaggauugguugcugguugguauggguuccagcauucaaaugaucaaggaacugguauggcugcagauagagacucgacucaaaaggcaauugacaaaauaacguccaaaguaaauaauauagucgauaaaaugaacaaacaguaugaaauuauugaucaugaauucagcgagauugaaacuagacucaauaugaucaauaauaagauugaugaucaaauucaagacauaugggcauauaacgcugaauugcuaguacugcuugaaaaucagaaaacgcuugaugagcaugaugcaaauguaaacaaucuguauaacaaagugaagagggcacuggguuccaaugcaguggaagaugggaaaggaugcuucgagcuauaccauaaaugcgauaaccagugcauggagacaauucgaaacgggaccuauaacagaagaaaguauaaagaggaaucaagacuagagagacagaaaauagagggggucaaacuggaaucugaaggaaccuacaaaauccucaccauuuauucgacugucgccucaucucuuguuauugcaaugggguucgcugccuucuuguucugggccauguccaauggaucuugcagaugcaacauuuguauauga

SEQ ID NO: 40775 - RNA, 1683 nt, Artificial Sequence
  hemagglutinin__InfluenzaA__AGQ81087
auggaaacaguaucacuaauaacuaugcuacuaguagcaacaguaaucaaugcagauaaaaucugcaucggcuaccaaucaacaaacuccacagaaacuguagacacauuaacagaaaacaaugucccugugacacaugccaaagaauugcuccacacagagcacaaugggaugcugugugcaacaaacuugggacauccucuuauucuagacaccuguaccauugaaggacuaaucuauggcaauccuucuugugaucuacuguuggggggaagagaaugguccuacaucguugagagaccaucggcuguuaauggauuguguuaccccgggaauguagaaaaucuagaagagcuaaggucacuuuuuaguucugcuaguuccuaucaaaggauccagauuuuuccagacacaaucuggaaugugucuuacagugggacaagcaaagcauguucagauucauucuacagaagcaugagaugguugacccaaaagaacaacgcuuacccuauucaagacgcccaauacacaaauaaucgagaaaagaacauucuuuucauguggggcauaaaucacccacccaccgauacugcgcagacaaaucuguacacaagaaccgacacaacaacaaguguggcaacagaagaaauaaauaggaccuucaaaccauugauaggaccaaggccucuugucaaugguuuacagggaagaauugauuauuauuggucgguauugaaaccaggucaaacacugcgaaucagauccaaugggaaucuaauagcuccaugguauggacacauucuuucaggagagagccacggaagaguccugaagacugaucuaaaaagggguagcuguacagugcaaugucagacagaaaaagguggcuuaaacacaacauugccauuccaaaauguaaguaaguaugcauuuggaaacuguucgaaauauguuggagugaagagucucaaacuugcaguaggucugaggaaugugccuucuagaucuaguagaggacuauucggggccauagcuggauucauagagggagguuggucaggacuaguugcugguugguauggauuccagcauucaaaugaccaagggguugguauggcagcagauagagacucaacccaaaaggcaauugauaaaaugacauccaaagugaauaacauagucgauaaaaugaacaaacaauaugaaauuauuaaucaugaauucagugagauugaaacuagacuuaacaugaucaauaauaagaucgaugaucaaauucaagacauaugggcauauaacgcagaguugcuagugcugcuugaaaaccagaaaacacucgaugagcaugaugcaaauguaaacaaucuauauaauaaagugaagagggcauuagguuccaaugcaguggaagaugggaaaggauguuucgagcuauaccacaaaugugaugaccagugcauggagacaauucggaacgggaccuacaacaggaggagguaucaagaggaaucaaaauuggaaagacagaaaauagagggggucaagcuggaaucugaaggaacuuacaaaauccucaccauuuauucgacugucgccucaucucuugugauugcaaugggguuugcugccuucuuguucugggccauguccaaugggucuugcagaugcaacauuuguauauaa

SEQ ID NO: 40776 - RNA, 1683 nt, Artificial Sequence
  hemagglutinin__InfluenzaA__AGQ81092
auggaaguaguaucacuaauaacuauacuacuaguaauaacaggaagcaaugcggauaaaaucugcauuggcuaccaaucaacaaacuccaccgaaacuguagacacgcuaaccgaaaacaauguuccugugacacaugccaaagaauugcuucacacagaacacaaugggaugcuaugugcaacaaaucugggacguccucuuauucuagacaccuguaccauugaaggacuaaucuauggcaacccuucuugugaucuacugcugggaggaagagaaugguccuauauugucgaaagaccaucggcuguuaauggacuguguuaccccggaaacguagaaaaccuagaagaauuaaggucacuuuuuagcucugcuaguucuuaccaaagaauccagaucuuuccagacacaaucuggaaugugucuuacacuggaacaagcaaagcauguucagauucauucuacagaagcaugaggugguugacucaaaagaacaaugcuuacccuguucaagacgcccaauacacaaauaauagaggaaggaacauucuuuucauguggggcauaaaucacccacccacugauacuacgcagacaaaucuguacacaaggacugacacaacaacaaguguggcgacagaagauauaaauaggaccuucaaaccauugauagggccaaggccucuugucaauggucugcaaggaaggauugacuauuauugggcgguguugagaccaggucagacauugcgaauaagauccaacgggaaucuaaucgcuccaugguauggacacauucuuucaggggagagucacggaagaauccugaaaacggauuuaaaaagugguaacuguguagugcaaugucaaacagaaagagguggcuugaauacuacauugccauuccacaacguaagcaaauacgcauuuggaaauugcccaaaauauguuggaguaaagagucucaaauuggcagucggucugaggaaugugccugcuagaucaaguagagggcuauuuggagccauagcugguuucauagaaggagguuggucaggauugguugcugguugguauggguuccagcauucaaaugaucaaggaacugguauggcugcagauagagacucgacucaaaaggcaauugacaaaauaacguccaaaguaaauaauauagucgauaaaaugaacaaacaguaugaaauuauugaucaugaauucagcgagauugaaacuagacucaauaugaucaauaauaagauugaugaucaaauucaagacauaugggcauauaacgcugaguugcuaguacugcuugaaaaucagaaaacacucgaugagcaugaugcaaauguaaacaaucuguauaacaaagugaagagggcacuggguuccaaugcaguggaagaugggaaaggaugcuucgagcuauaccauaaaugcgauaaccagugcauggagacaauucgaaacgggaccuauaacagaagaaaguauaaagaggaaucaagacuagagagacagaaaauagagggggucaaacuggaaucugaaggaaccuacaaaauccucaccauuuauucgacugucgccucaucucuuguuauugcaaugggguucgcugccuucuuguucugggccauguccaauggaucuugcagaugcaacauuuguauauga

SEQ ID NO: 40777 - RNA, 1683 nt, Artificial Sequence
  hemagglutinin__InfluenzaA__AGQ81095
auggaaguaguaucacuaauaacuauacuacuaguaauaacaguaagcaaugcggauaaaaucugcauuggcuaccaaucaacaaacuccaccgaaacuguaaacacgcuaaccgaagacaauguuccugugacacaugccaaagaauugcuucacacagaacacaaugggaugcuaugugcaacaaaucugggacgcccucuuauucuagacaccuguaccauugaaggacuaaucuauggcaacccuucuugugaucuacugcugggaggaagagaaugguccuauauugucgaaagaccaucugcuguuaauggacuguguuaccccggaaacguagaaaaccuagaagaauuaaggucacuuuuuagcucugcuaguucuuaccaaagaauccagaucuuuccagacacaaucuggaaugugucuuacaguggaacaagcaaagcauguucagauucauucuacagaagcaugagaugguugacucaaaagaacaaugcuuacccuguucaagacgcccaauacacaaauaauagaggaaggaacauucuuuucauguggggcauaaaucacccacccacugauacugcgcagacaaaucuguacacaaggacugacacaacaacaaguguggcgacagaagauauaaauaggaccuucaaaccauugauagggccaaggccucuugucaauggucugcaaggaaggauugacuauuauugggcgguguugaaaccaggucagacauugcgaauaagauccaacgggaaucuaaucgcuccaugguauggacacauucuuucaggggagagucacggaagaauccugaaaacggauuuaaacagcgguaacuguguagugcaaugucaaucagaaagagguggcuugaauacuacauugccauuccacaacguaagcaaguacgcauuuggaaauugcccaaaauauguuggaguaaagagucucaaauuggcagucggucugaggaaugugccugcuagaucaaguagagggcuauuuggagccauagcugguuucauagaaggagguuggucaggauugguugcuggcugguauggguuccagcauucaaaugaucaggggacugguauggcugcagauagagacucgacgcaaaaggcaauugacaaaauaacauccaaaguaaauaauauagucgauaaaaugaacaaacaguaugaaauuauugaucaugaauucagcgagauugaaacuagacuuaauaugaucaauaauaagauugaugaccaaauucaggacauaugggcauauaaugcugaauugcuaguacugcuugaaaaucagaaaacgcucgaugagcaugaugcaaauguaaacaaccuguauaacaaagugaagagggcacuggguuccaaugcaguggaagaugggaaaggaugcuucgagcuauaccauaaaugcgauaaccagugcauggagacaauucgaaacggaaccuaugacagaagaaaguauaaagaggaaucaagacuagagagacagaaaauagagggggucaaacuggaaucugaaggaaccuacaaaauccucaccauuuauucgacugucgccucaucucuuguuauugcaaugggguucgcugccuucuuguucugggccauguccaauggaucuugcaggcgcaacauuuguauauaa

SEQ ID NO: 40778 - RNA, 1683 nt, Artificial Sequence
  hemagglutinin__InfluenzaA__AGQ81099
auggaaacaguaucacuaauaacuauacuacuaauaguaacaguaagcaaugcagauaaaauuugcaucggcuaccaaucaacaaacuccacagaaacuguagacacacuaacagaaaacaauguccccguuacacaugccaaagaauugcuccacacagagcacaaugggaugcugugugcuacaaauuugggacauccucuuauucuagacaccuguaccauugaaggacuaaucuacggcaauccuucuugugaucuacuguugggaggaagagaaugguccuacaucgucgagagaccaucggcuguaaauggauuguguuaccccgggaauguagaaaaucuagaagagcuaaggucacuuuuuaguucugcuaauucuuaucaaaggauccagaucuuuccagacacaaucuggaaugugucuuacagugggacaagcaaagcauguucagauuccuucuauagaagcaugagaugguugacccaaaagaacaacgcuuaccccacucaagaugcccaauacacaaauaaucgagagaagaacauucuuuucauguggggcauaaaucacccacccaccgauacugcgcagacaaaucuguacacaagaaccgacacaacaacaaguguggcaacagaagaaauaaauaggaccuucaaaccauugauaggaccgaggccucuugucaaugguuugcagggaagaauugauuauuauuggucgguauugaaaccaggucaaacauugcgaauaagauccaaugggaaccuaauagcuccaugguauggacacauucuuucaggagagagucacggaagaauccugaagaccgaucuaaaaagggguagcuguacgguacaaugucagacagaaaaagguggauuaaacacaacauugccauuccaaaauguaaguaaguaugcauuuggaaacugcucgaaauauguuggaguaaagagucucaaacuugcaguuggucugaggaaugugccuucuagaucaaguagaggacuauucggagccauagcuggauucauagaaggagguuggucaggacuaguugcugguugguauggauuccagcauucaaaugaccaagggguugguauggcagcagauagagacucaacccaaaaggcaauugauaaaguaacauccaaagugaauaacauagucgacaaaaugaacaaacaguaugaaauuauugaucaugaauucagcgagguugaaacuagacuuaacaugaucaacaauaagauugaugaucaaauucaagacauaugggcauauaacgcagaauugcuugugcugcuugaaaaccagaagacacucgaugagcaugaugcaaauguaaauaaucuauauaauaaaguaaagagggcauuggguuccaaugcaguggaagaugggaaaggauguuucgagcuauaccacaaaugugaugaccagugcauggagacaauucggaacgggaccuacaacaggaggaaguaucaagaggaaucaaaauuagaaagacagaaaauagagggggucaagcuggaaucugaaggaacuuacaaaauccucaccauuuauucgacugucgccucaucucuugugauugcaaugggguuugcugccuucuuguucugggcuauguccaauggaucuugcaggcgcaacauuuguauauaa

SEQ ID NO: 40779 - RNA, 1683 nt, Artificial Sequence
  hemagglutinin__InfluenzaA__AGQ81100
auggaaacaguaucacuaauaacuaugcuacuaguagcaacaguaaucaaugcagauaaaaucugcaucggcuaccaaucaacaaacuccacagaaacuguagacacauuaacagaaaacaaugucccugugacacaugccaaagaauugcuccacacagagcacaaugggaugcugugugcaacaaacuugggacauccucuuauucuagacaccuguaccauugaaggacuaaucuauggcaauccuucuugugaucuacuguugggaggaagagaaugguccuacaucguugagagaccaucggcuguuaauggauuguguuaccccgggaauguagaaaaucuagaagagcuaaggucacuuuuuaguucugccaguuccuaucaaaggauccagauuuuuccagacacaaucuggaaugugucuuacagugggacaagcaaagcauguucagauucauucuacagaagcaugagauggcugacccaaaagaacaacgcuuacccuauucaagacgcccaauacacaaauaaucgagaaaagaacauucuuuucauguggggcauaaaucacccacccaccgauacugcgcagacaaaucuguacacaagaaccgacacaacaacaaguguggcaacagaagaaauaaauaggaccuucaaaccauugauaggaccaaggccucuugucaaugguuuacagggaagaauugauuauuauuggucgguauugaaaccaggucaaacacugcgaaucagauccaaugggaaucuaauagcuccaugguauggacacauucuuucaggagagagccacggaagaauccugaagacugaucuaaaaagggguagcuguacagugcaaugucagacagagaaagguggauuaaacacaacauugccauuccaaaauguaaguaaguaugcauuuggaaacuguucgaaauauguuggagugaagagucucaaacuugcaguaggucugaggaaugugccuucuagaucuaguagaggacuauucggggccauagcuggauucauagagggagguuggucaggacuaguugcugguugguauggauuccagcauucaaaugaccaagggguugguauggcagcagauagagacucaacccaaaaggcaauugauaaaauaacauccaaagugaauaacauagucgauaaaaugaacaaacaauaugaaauuauugaucaugaauucagugagguugaaacuagacuuaacaugaucaauaauaagaucgaugaucaaauucaagacauaugggcauauaacgcagaguugcuagugcugcuugaaaaccagaaaacacucgaugagcaugaugcaaauguaaacaaucuauauaauaaagugaagagggcauuagguuccaaugcaguggaagaugggaaaggauguuucgagcuauaccacaaaugugaugaccaguguauggagacaauucggaacgggaccuacaacaggaggagguaucaagaggaaucaaaauuggaaagacagaaaauagagggggucaagcuggaaucugaaggaacuuacaaaauccuuaccauuuauucgacugucgccucaucucuugugauugcaaugggguuugcugccuucuuguucugggccauguccaaugggucuugcaggcgcaacauuuguauauaa

SEQ ID NO: 40780 - RNA, 1683 nt, Artificial Sequence
  hemagglutinin__InfluenzaA__AGQ81123
auggaaguaguaucacuaauaacuauacuacuaguaauaacaguaagcaaugcggauaagaucugcauuggcuaccaaucaacaaacuccaccgaaacuguaaacacgcuaaccgaagacaauguuccugugacacaugcuaaagaauugcuucacacagaacacaaugggaugcucugugcaacaaaucugggacgcccucuuauucuagacaccuguaccauugaaggacuaaucuauggcaacccuucuugugaucuacugcugggaggaagagaaugguccuauauugucgaaagaccaucggcuguuaauggacuguguuaccccggaaacguagaaaaccuagaagaauuaaggucacuuuuuagcucugcuagcucuuaccaaagaauccagaucuuuccagacacaaucuggaaugugucuuacaguggaacaagcaaagcauguucagauucauucuacagaagcaugagaugguugacgcaaaagaacaaugcuuacccuguucaagacgcccaauacacaaauaauaaaggaaggaacauucuuuucauguggggcauaaaucacccacccacugauacugcgcagacaaaucuguacacaaggacugacacaacaacaaguguggcgacagaagauauaaauaggaccuucaaaccauugauagggccaaggccucuugucaacggucuacaaggaaggauugacuauuauugggcaguguugaaaccaggucagacauugcgaauaagauccaacggaaaccuaaucgcuccaugguaugggcacauucuuuuaggggagagucauggaagaauccugaaaacggauuuaaacaguggugacuguguagugcaaugucaaucagaaagagguggcuugaauacuacauugccauuucacaacguaagcaaguacgcauuuggaaauugcccaaaauauguuggaguaaagagucucaaauuggcagucggucugaggaauguaccugcuagaucaacuagagggcuauuuggagccauagcugguuucauagaaggagguuggucaggauugguugcuggcugguauggguuccagcauucaaaugaucagggaacugguauggcugcagauagagacucgacgcaaaaggcaauugacaaaauaacauccaaaguaaauaauauagucgauaaaaugaacaaacaguaugaaauuauugaucaugaauucagcgagauugaaacuagacuuaauaugaucaauaauaagauugacgaucaaauucaggacauaugggcauauaaugcugaauugcuaguacugcuugaaaaucagaaaacgcucgaugagcaugaugcaaauguaaacaaucuguauaacaaagugaagagggcacuggguuccaaugcaguggaagaugggaaaggaugcuucgaguuauaccauaaaugcgauaaccaguguauggagacaauucgaaacgggaccuaugacagaagaaaguauaaagaggaaucaagacuagagagacagaaaauagaggggguuaaacuggaaucugaaggaaccuacaaaauccucaccauuuauucgacugucgccucaucucuuguuauugcaaugggguucgcugccuucuuguucugggccauguccaauggaucuugcagaugcaacauuuguauauga

SEQ ID NO: 40781 - RNA, 1683 nt, Artificial Sequence
  hemagglutinin__InfluenzaA__AGQ81124
auggaaguagcaacacuaauaacuauacuacuaguaauaacaggaagcaaugcggauaaaaucugcauuggcuaccaaucaacaaacuccacagaaacuguagacacgcuaaccgaaaacaauguuccugugacacaugcuaaagaauugcuucauacagagcacaaugggaugcuaugugcaacaaaccuggggcguccucuuauacuagacaccuguaccauugaaggacuaaucuauggcaacccuucuugugaucuaccgcuggaagggagagaaugguccuacauugucgaaagaccaucggcuguuaauggagugugcuaccccggaaauguagaaaaccuagaagaauuaaggucacuuuuuaguuccgcuaguucuuaucaaagaauccagaucuuuccagauucaaucuggaaugugucuuacaguggaacaagcaaagcauguucagauucauucuacagaaacaugaggugguugacucaaaaggacaacaauuacccuguucaagacgcccaauacacaaauaauagaggaaagaacauucuuuucauguggggcauaaaucacccacccacugauacugcacagacaaaucuguacacaaggacugacacaacaacaaguguggcgacggaagauauaaauaggaccuucaaaccauugauagggccaaggccucuugucaauggucuacaaggaaggauugauuauuauugggcgguguuaaaaccaggucagacauugcgaguaagauccaacgggaaucuaaucgcuccaugguaugggcacauucucuuaggggagagucauggaagaauccugaaaacggauuuaaagagugguaacuguguagugcaaugucaaacagaaagaggugguuugaacacuacauugccauuucacaacguaagcaaguacgcauuuggaaauugcccaaaauauauuggaguaaagagucucaaauuggcagucggucugaggaaugugccugcuagaucaaguagaggacuauuuggagccauagcugguuucauagagggagguuggucaggauuaguugcugguugguauggguuccagcauucaaaugaucaaggaaccgguauggcugcagauagagacucaacucaaaaggcaauugacaaaauaacguccaaaguaaauaauauagucgacaaaaugaacaaacaguaugaaauuauugaccaugaauucagcgagauugaaacuagacucaauaugaucaaugauaagauugaugaccaaauucaagacauaugggcauauaaugcugaauugcuaguacugcuugaaaaucaaaagacucucgaugagcaugacgcaaauguaaacaaucuauauaacaaagugaagagggcacuggguuccaaugcaguggaagaugggaaaggaugcuucgaucuauaccauaaaugcgauaaccagugcauggagacaauucgaaacgggaccuauaacagaagaaaguaucagaaggaaucaagacuagagagacagaaaauagagggggucaaacuggaaucugaaggaaccuacaaaauccucaccauuuauucgacugucgccucaucucuuguuauugcaaugggguucgcugccuucuuguucugggccauguccaauggaucuugcagaugcaacauuuguauauaa

SEQ ID NO: 40782 - RNA, 1683 nt, Artificial Sequence
  hemagglutinin__InfluenzaA__AGQ81125
auggaaguagcaacacuaauaacuauacuacuaguaauaacaggaagcaaugcggauaaaaucugcauuggcuaccaaucaacaaacuccacagaaacuguagacacgcuaaccgaaaacaauguuccugugacacaugcuaaagaauugcuucauacagagcacaaugggaugcuaugugcaacaaaccuggggcguccucuuauacuagacaccuguaccauugaaggacuaaucuauggcaacccuucuugugaucuaccgcuggaagggagagaaugguccuacauugucgaaagaccaucggcuguuaauggagugugcuaccccggaaauguagaaaaccuagaagaauuaaggucacuuuuuaguuccgcuaguucuuaucaaagaauccagaucuuuccagauucaaucuggaaugugucuuacaguggaacaagcaaagcauguucagauucauucuacagaagcaugaggugguugacucaaaaggacaacaauuacccuguucaagacgcccaauacacaaauaauagaggaaagaacauucuuuucauguggggcauaaaucacccacccacugauacugcacagacaaaucuguacacaaggacugacacaacaacaaguguggcgacggaagauauaaauaggaccuucaaaccauugauagggccaaggccucuugucaauggucuacaaggaaggauugauuauuauugggcgguguuaaaaccaggucagacauugcgaguaagauccaacgggaaucuaaucgcuccaugguaugggcacauucucuuaggggugagucauggaagaauccugaaaacggauuuaaagagugguaacuguguagugcaaugucaaacagaaagaggugguuugaacacuacauugccauuucacaacguaagcaaguacgcauuuggaaauugcccaaaauauauuggaguaaagagucucaaauuggcagucggucugaggaaugugccugcuagaucaaguagaggacuauuuggagccauagcugguuucauagagggagguuggucaggauuaguugcugguugguauggguuccagcauucaaaugaucaaggaaccgguauggcugcagauagagacucaacucaaaaggcaauugacaaaauaacguccaaaguaaauaauauagucgacaaaaugaacaaacaguaugaaauuauugaccaugaauucagcgagauugaaacuagacucaauaugaucaaugauaagauugaugaccaaauucaagacauaugggcauauaaugcugaauugcuaguacugcuugaaaaucaaaagacucucgaugagcaugacgcaaauguaaacaaucuauauaacaaagugaagagggcacuggguuccaaugcaguggaagaugggaaaggaugcuucgaucuauaccauaaaugcgauaaccagugcauggagacaauucgaaacgggaccuauaacagaagaaaguaucaggaggaaucaagacuagagagacagaaaauagagggggucaaacuggaaucugaaggaaccuacaaaauccucaccauuuauucgacugucgccucaucucuuguuauugcaaugggguucgcugccuucuuguucugggccauguccaauggaucuugcagaugcaacauuuguauauaa

SEQ ID NO: 40783 - RNA, 1683 nt, Artificial Sequence
  hemagglutinin__InfluenzaA__AGQ81126
auggaaacaauaucacuaaugacuauacuacugauaacgacagcaagcaaugcagauaaaaucugcaucggucaccagucaacaaacuccacagaaacuguggacacgcuaacagaaaccaauguuccugugacacaugccaaagaauugcuccaaacagagcacaauggaaugcugugugcgacaaaucuggggcauccccucauucuagacacaugcacuaucgaaggacuaaucuauggcaaccccucuugugaccugcuauuggagggaagagaaugguccuacauagucgaaagacccucagcuguaaacggaacuuguuacccugggaauguagaaaaccuagaggaacucaggacacuuuuuaguuccgccaguuccuaccaaagaauccaaaucuucccagacacaauauggaauguuacuuacacuggaacaagcagaucauguucagguucauucuacaggaguaugagauggcugacucaaaaaagcggguuuuacccuguccaagacgccaaauacacaaauaacagggggaagaacauccucuucgugugggguauacaucacccacacaccuauaccgaccaaacaacuuuguacauaagaaacgacacaacaacaagugugacaacagaggaguugaauagaaucuucaaaccagugauagugccaaggcuucuugucaauggucagcaggggagaauugauuauuauuggucaguacuaaaaccaggccaaacauugcgaguaagauccaaugggaaucuaauugcuccaugguauggacacguucuuucaggagggagccauggaagaauccugaagacugauuuaaaaggugguaauuguguagugcaaugucagacugaaaaggguggauucaacaguacauugcccuuccacaauaucagcaaauaugcauuuggaaccugccccaaauauguaaaagucaauagucucaaacuggcaauuggucugaggaaugugccugcuagaucaaauagaggacuauuuggggcuaucgcugguuucauagaaggagguuggccaggacuaguagcuggcugguaugguuuccagcauucaaaugaucaagggguugguauggccgcagauagggauucaacucaaaaggcaguugauaaaauaacaucuaaggugaauaauauagucgacaagaugaauaagcaauaugaaauaauugaucaugaauucagugagguugaaacuagacucaauaugaucaauaauaagauugaugaccaaauacaagacauaugggcauauaaugcagaacugcuaguacuacuugaaaaccagaaaacgcucgaugagcaugaugcgaacguaaacaaucuauauaacaaggugaagagggcccugggcuccaaugcuauggaagaugggaaagguuguuucgaguuauaccauaagugugaugaucaaugcauggaaacaauucgaaacgggaccuauaauaggagaaaguauagagaggaaucaagauuagaacagcagagaauagaagggguuaaacuggaaucugagggaacuuacaaaauccucacuauuuauucgacugucgccucaucucuugugcuugcgaugggguuugcugccuuccuguucugggccauguccaaugguucuugcaggugcaacauuuguauauaa

SEQ ID NO: 40784 - RNA, 1683 nt, Artificial Sequence
  hemagglutinin__InfluenzaA__AGQ81127
auggaaguagcaacacuaauaacuauacuacuauuaauaacaggaagcaaugcggauaaaaucugcauuggcuaccaaucaacaaacuccacagaaacuguagacacacuaaccgaaaacaauguuccugugacacaugcuaaagaauugcuucacacagagcacaaugggaugcuaugugcaacaaaccuggggcguccucuuauucuagacaccuguaccauugaaggacuaaucuauggcaacccuucuugugaucuaccgcuggaagggagagaaugguccuacauugucgaaagaccaucggcuguuaauggagugugcuaccccggaaauguagaaaaccuagaagaauuaaggucacuuuuuaguucugcuaguucuuaccaaagaauccagaucuuuccagauucaaucuggaaugugucuuacaguggaacaagcaaagcauguucagauucauucuacagaagcaugaggugguugacucaaaagaacaacaauuacccuguucaagacgcccaauacacaaauaauagaggaaagaacauucuuuucauguggggcauaaaucacccacccacugauacugcacagacuaaucuguacacaaggacugacacaacaacaaguguggcgacggaagauauaaauaggaccuucaaaccauugauagggccaaggccucuugucaauggucuacaaggaaggauugauuauuauugggcgguguuaaaaccaggucagacauugcgaguaagauccaacgggaaucuaaucgcuccaugguauggacacauucucuuaggggagagucacggaagaauccugaaaacggauuuaaagagugguaacuguguagugcaaugucaaacagaaagaggugguuugaacacuacauugccauuucacaacguaagcaaguacgcauuuggaaauugcccaaaauauauuggaguaaagagucucaaauuggcagucggucugaggaaugugccugcuagaucaaguagaggacuauuuggagccauagcugguuucauagagggagguuggucaggauuaguugcugguugguauggguuccagcauucaaaugaucaaggaaccgguauggcugcagauagagacucaacucaaaaggcaauugacaaaauaacguccaaaguaaauaauauagucgacaaaaugaacaaacaguaugaaauuauugaccaugaauucagcgagauugaaacuagacucaauaugaucaaugauaagauugaugaccaaauucaagacauaugggcauauaaugcugaauuguuaguacugcuugaaaaucaaaaaacucucgaugagcaugacgcaaauguaaacaaucuauauaacaaagugaagagggcacuggguuccaaugcaguggaagaugggaaaggaugcuuugaucuauaccauaaaugcgauaaccagugcauggagacaauucgaaacgggaccuauaacagaagaaaguaucaggaggaaucaagacuagagagacagaaaauagagggggucaaacuggaaucugaaggaaccuacaaaauccucaccauuuauucgacugucgccucaucucuuguuauugcaaugggguucgcugccuucuuguucugggccaugucuaauggaucuugcagaugcaacauuuguauauaa

SEQ ID NO: 40785 - RNA, 1683 nt, Artificial Sequence
  hemagglutinin__InfluenzaA__AGQ81128
auggaagcagcaacaauaauaacuauacuacuaguaauaacaggaagcaaugcggauaaaaucugcauuggcuaccaaucaacaaacuccacagaaacuguagacacgcuaaccgaaaacaauguuccugugacacaugcgaaagaauugcuucacacagagcacaaugggaugcuaugugcaacaaaccuggggcguccucuuauucuagacaccuguaccauugaaggauuaaucuauggcaacccuucuugugaucuaccgcuggaagggagagaaugguccuacauugucgaaagaccaucggcuguuaauggagugugcuaccccggaaauguagaaaaccuggaggaauuaaggucacuuuuuaguuccgcuaguucuuaccaaagaauccagaucuuuccagauucaaucuggaauguaucuuacaguggaacaagcaaagcauguucagauucauucuacagaagcaugaggugguugacucaaaagaacaacaauuauccuguucaagacgcccaauacacaaauaauagaggaaagaacauucuuuucaugugggguauaaaucacccacccacugauacugcacagacaaaucuguacacaaggacugacacaacaacaaguguggcgacggaagacauaaauaggaccuucaaaccauugauagggccaaggccucuugucaauggucuacaaggaaggauugauuauuauugggcgguguuaaaaccaggucagacauugcgaguaagauccaacgggaaucuaaucgcuccaugguauggacacauucucuuaggggagagucacggaagaauccugaaaacggauuuaaagagugguaacuguguagugcaaugucaaacagaaagaggugguuugaacacuacauugccauuucacaacgugagcaaguacgcauucggaaauugcccaaaauauauuggaguaaagagucucaaauuggcagucggucugaggaaugugccugcuagaucaaguagaggacuauuuggagccauagcugguuucauagagggagguuggucaggauuaguugcugguugguauggguuccagcauucaaaugaucaaggaaccggaauggcugcagauagagacucaacucaaaaggcaauugacaaaauaacguccaaaguaaauaauauagucgacaaaaugaacaaacaguaugauauuauugaccaugaauucagcgagauugaaacuagacucaauaugaucaaugauaagauugaugaccaaauccaagacauaugggcauauaaugcugaauugcuaguacugcuugaaaaucaaaaaacucucgaugagcaugacgcaaauguaaacaaucuauauaacaaagugaagagggcacuggguuccaaugcaguggaagaugggaaaggaugcuucgaucuauaccauaaaugcgauaaccagugcauggagacaauucgaaacgggaccuauaacagaagaaaguaucaggaggaaucaagacuagagagacagaaaauagagggggucaaacuggaaucugaaggaaccuacaaaauccucaccauuuauucgacugucgccucaucucuuguuguugcaaugggguucgcugccuucuuguucugggccaugucuaauggaucuugcagaugcaacauuuguauauaa

SEQ ID NO: 40786 - RNA, 1683 nt, Artificial Sequence
  hemagglutinin__InfluenzaA__AGQ81130
auggagacaguaucacuaauaacuauacuacuaguaguaacaauaggcaaugcagauaaaaucugcaucggcuaccaaucaacaaacuccacagaaacuguagacacacuaacagaaaacaaugucccugugacacaugccaaagaauugcuccacacagagcauaaugggaugcugugugcaacaagcuugggacacccucuuauucuagacaccuguaccauugaaggacuaaucuauggcaauccuucuugugaucuauuguugggaggacgagaaugguccuauaucgucgagagaccaucagcuguuaacggauuguguuaucccgggaauguagaaaaucuagaagagcuaaggucacuuuuuaguucugcuaggucuuaucaaaggauccagauuuucccagacacaaucuggaaugugucuuacagugggacaagcaaagcauguucagauucauucuacagaagcaugagaugguugacucaaaagaacaacgcuuacccuauucaagacgcccaauacacaaauaaucaagaaaagaacauucuuuucauguggggcauaaaucacccacccaccgauacugugcagacaaaucuguacacaagaaccgacacaacaacgaguguggcaacagaagaaauaaauaggaccuucaaaccauugauaggaccaaggccucuugucaaugguuugcagggaagaauugauuauuauuggucgguauugaaaccgggucaaacacugcgaauaagaucuaaugggaaucuaauagcuccaugguauggacacauucuuucaggagagagccacggaagaauccuaaagacugauuuaaaaagggguagcugcacagugcaaugucagacagaaaaaggcggcuuaaacacaacauugccauuccaaaacguaaguaaguacgcauuuggaaacugcucuaaauacauuggcaugaagagucucaaacuugcaguuggucugaggaaugugccuucuagaucuaguagaggacuauucggggccauagcaggauuuauagagggagguuggucaggacuaguugcuggcugguauggauuccagcauucaaaugaccaagggguugguauggcagcagauagagacucaacccaaaaggcaauugauaaaauaacauccaaagugaauaacauagucgacaaaaugaacaagcaguaugaaauuauugaucaugaauucagcgagguugaaacuagacuuaacaugaucaauaauaagauugaugaucagauccaagauauaugggcauauaaugcagaauugcuaguucugcuugaaaaccaaaaaacacucgaugagcaugaugcaaauguaaacaaucuauauaauaaagugaagagggcauuggguuucaaugcgguggaagaugggaaaggauguuucgagcuauaccacaaaugugaugaccagugcauggagacaauucgaaacgggaccuacaacaggaggaaguaucaagaggaaucaaaauuagaaagacagaaaauagagggggucaagcuggaaucugaaggaacuuacaagauccucaccauuuauucgacugucgccucaucucuugugauugcaaugggguuugcugccuucuuguucugggccauguccaaugggucuugcagaugcaacauuuguauauaa

SEQ ID NO: 40787 - RNA, 1683 nt, Artificial Sequence
  hemagglutinin__InfluenzaA__AGQ81132
auggaaacaauaucacuaaugacuauacuacugauaacgacagcaagcaaugcagauaaaaucugcaucggucaccagucaacaaacuccacagaaacuguggacacgcuaacagaaaccaauguuccugugacacaugccaaagaauugcuccaaacagagcacaauggaaugcugugugcgacaaaucuggggcauccccucauucuagacacaugcacuaucgaaggacuaaucuauggcaaccccucuugugaccugcuauuggagggaagagaaugguccuacauagucgaaagacccucagcuguaaacggaacuuguuacccugggaauguagaaaaccuagaggaacucaggacacuuuuuaguuccgccaguuccuaccaaagaauccaaaucuucccagacacaauauggaauguuacuuacacuggaacaagcagaucauguucagguucauucuacaggaguaugagauggcugacucaaaaaagcggguuuuacccuguccaagacgccaaauacacaaauaacagggggaagaacauccucuucgugugggguauacaucacccacacaccuauaccgaccaaacaacuuuguacauaagaaacgacacaacaacaagugugacaacagaggaguugaauagaaucuucaaaccagugauagugccaaggcuucuugucaauggucagcaggggagaauugauuauuauuggucaguacuaaaaccaggccaaacauugcgaguaagauccaaugggaaucuaauugcuccaugguauggacacguucuuucaggagggagccauggaagaauccugaagacugacuuaaaaggugguaauuguguagugcaaugucaaacugaaaaggguggauucaacaguacauugcccuuccacaauaucagcaaauaugcauuuggaaccugccccaaauauguaaaagucaauagucucaaacuggcaauuggucugaggaaugugccugcuagaucaaauagaggacuauuuggggcuaucgcugguuucauagaaggagguuggccaggacuaguagcuggcugguaugguuuccagcauucaaaugaucaagggguugguauggccgcagauagggauucaacucaaaaggcaguugauaaaauaacaucuaaggugaauaauauagucgacaagaugaauaggcaauaugaaauaauugaucaugaauucagugagguugaaacuagacucaauaugaucaauaauaagauugaugaccaaauacaagacauaugggcauauaaugcagaacugcuaguacuacuugaaaaccagaaaacgcucgaugagcaugaugcgaacguaaacaaucuauauaacaaggugaagagggcccugggcuccaaugcuauggaagaugggaaagguuguuucgaguuauaccauaagugugaugaucaaugcauggaaacaauucgaaacgggaccuauaauaggagaaaguauagagaggaaucaagauuagaacagcagagaauagaagggguuaaacuggaaucugagggaacuuacaaaauccucacuauuuauucgacugucgccucaucucuugugcuugcgaugggguuugcugccuuccuguucugggccauguccaaugguucuugcaggugcaacauuuguauauaa

SEQ ID NO: 40788 - RNA, 1683 nt, Artificial Sequence
  hemagglutinin__InfluenzaA__AGQ81133
auggaaacaauaucacuaaugacuauacuacugauaacgacagcaagcaaugcagauaaaaucugcaucggucaccagucaacaaacuccacagaaacuguggacacgcuaacagaaaccaauguuccugugacacaugccaaagaauugcuccaaacagagcacaauggaaugcugugugcgacaaaucuggggcauccccucauucuagacacaugcacuauugaagggcuaaucuauggcaaccccucuugugaccugcuauuggagggaagagaaugguccuacauagucgaaagacccucagcuguaaacggaacuuguuacccugggaauguagaaaaccuagaggaacucaggacacuuuuuagcuccgccaguuccuaccaaagaauccaaaucuucccagacacaauauggaauguuacuuacacuggaacaagcagaucauguucagguucauucuacaggaguaugagauggcugacucaaaaaagcggguuuuacccuguccaagacgccaaauacacaaauaacagggggaagaacauccucuucgugugggguauacaucacccacauaccuauaccgaccaaacaacuuuguacauaagaaacgacacaacaacaagugugacaacagaggaguugaauagaaucuucaaaccagugauagugccaaggcuucuugucaauggucagcaggggagaauugauuauuauuggucaguacuaaaaccaggccaaacauugcgaguaagauccaaugggaaucuaauugcuccaugguauggacacauucuuucaggagggagccauggaagaauccugaagacugauuuaaaaagugguaauuguguagugcaaugucagacugaaaaggguggauucaacaguacauugcccuuccacaauaucagcaaauaugcauuuggaaccugccccaaauauguaaaagucaauagucucaaacuggcaauuggucugaggaaugugccugcuagaucaaauagaggacuauuuggggcuaucgcugguuucauagaaggagguuggccaggacuaguagcuggcugguaugguuuccagcauucaaaugaucaagggguugguauggccgcagauagggauucaacucaaaaggcaguugauaaaauaacaucuaaggugaauaauauagucgacaagaugaauaagcaauaugaaauaauugaucaugaauucagugagguugaaacuagacucaauaugaucaauaauaagauugaugaccaaauacaagacauaugggcauauaaugcagaacugcuaguacuacuugaaaaccagaaaacgcucgaugagcaugaugcgaacguaaacaaucuauauaacaaggugaagagggcccugggcuccaaugcuauggaagauggaaaagguuguuucgaguuauaccauaagugugaugaucaaugcauggaaacaauucgaaacgggaccuauaauaggagaaaguauagagaggaaucaagauuagaacagcagagaauagaagggguuaaacuggaaucugagggaacuuacaaaauccucacuauuuauucgacugucgccucaucucuugugcuugcgaugggguuugcugccuuccuguucugggccauguccaaugguucuugcaggugcaacauuuguauauaa

SEQ ID NO: 40789 - RNA, 1683 nt, Artificial Sequence
  hemagglutinin__InfluenzaA__AGQ81134
auggaaacaauaucacuaaugacuauacuacugauaacgacagcaagcaaugcagauaaaaucugcaucggucaccagucaacaaacuccacagaaacuguggacacgcuaacagaaaccaauguuccugugacacaugccaaagaauugcuccaaacagagcacaauggaaugcugugugcgacaaaucuggggcauccccucauucuagacacaugcacuauugaagggcuaaucuauggcaaccccucuugugaccugcuauuggagggaagagaaugguccuacauagucgaaagacccucagcugcaaacggaaccuguuacccugggaauguagaaaacccagaggaacucaggacacuuuuuagcuccgccaguuccuaccaaagaauccaaaucuucccagacacaauauggaauguuacuuacacuggaacaagcagaucauguucagguucauucuacaggaguaugagauggcugacucaaaaaagcggguuuuacccuguccaagacgccaaauacacaaauaacagggggaagaacauccucuucgugugggguauacaucacccacacaccuauaccgaccaaacaacuuuguacauaagaaacgacacaacaacaagugugacaacagaggaguugaauagaaucuucaaaccagugauagugccaaggcuucuugucaauggucagcaggggagaauugauuauuauuggucaguacuaaaaccaggccaaacauugcgaguaagauccaaugggaaucuaauugcuccaugguauggacacguucuuucaggagggagccauggaagaauccugaagacugauuuaaaaagugguaauuguguagugcaaugucagacugaaaaggguggauucaacaguacauugcccuuccacaauaucagcaaauaugcauuuggaaccugccccaaauauguaaaagucaauagucucaaacuggcaauuggucugaggaaugugccugcuagaucaaauagaggacuauuuggggcuaucgcugguuucauagaaggagguuggccaggacuaguagcuggcugguaugguuuccagcauucaaaugaucaagggguugguauggccgcagauagggauucaacucaaaaggcaguugauaaaauaacaucuaaggugaauaauauagucgacaagaugaauaagcaauaugaaauaauugaucaugaauucagugagguugaaacuagacucaauaugaucaauaauaagauugaugaccaaauacaagacauaugggcauauaaugcagaacugcuaguacuacuugaaaaccagaaaacgcucgaugagcaugaugcgaacguaaacaaucuauauaacaaggugaagagggcccugggcuccaaugcuauggaagaugggaaagguuguuucgaguuauaccauaagugugaugaucaaugcauggaaacaauucgaaacgggaccuauaauaggagaaaguauagagaggaaucaagauuagaacagcagagaauagaagggguuaaacuggaaucugagggaacuuacaaaauccucacuauuuauucgacugucgccucaucucuugugcuugcgaugggguuugcugccuuccuguucugggccauguccaaugguucuugcaggugcaacauuuguauauaa

SEQ ID NO: 40790 - RNA, 1683 nt, Artificial Sequence
  hemagglutinin__InfluenzaA__AGQ81135
auggaaguagcaacaauaauaacuauacuacuaguaauaacaggaagcaaugcggauaaaaucugcauuggcuaccaaucaacaaacuccacagaaacuguagacacgcuaaccgaaaacaauguuccugugacacaugcuaaagaauugcuccacacagagcacaaugggaugcuaugugcaacaaaccuggggcguccucuuauucuagacaccuguaccauugaaggacuaaucuauggcaacccuucuugugaucuaccgcuggaagggagagaaugguccuacauugucgaaagaccaucggcuguuaauggagugugcuaccccggaaauguagaaaaccuagaagaauuaaggucacuuuuuaguuccgcuaguucuuaccaaagaauccagaucuuuccagauucaaucuggaaugugucuuacaguggaacaagcaaagcauguucagauucauucuacagaagcaugaggugguugacucaaaagaacaacaauuacccuguucaagacgcccaauacacaaauaauagaggaaagaacauucuuuucauguggggcauaaaucacccacccacugauaaugcacagacaaaucuauacacaaggacugacacaacaacaaguguggcgacggaagauauaaauaggaccuucaaaccauugauagggccaaggccucuugucaauggucuacaaggaaggauugauuauuauugggcgguguuaaaaccaggucagacauugcgaguaagauccaacgggaaucuaaucgcuccaugguauggacacauucucuuaggggagagucacggaagaauccugaaaacggauuuaaaaagugguaacuguguagugcaaugucaaacagaaagaggugguuugaacacuacauugccauuucacaacguaagcaaguacucauuuggaaauugcccaaaauauauuggaguaaagagucucaaauuggcagucggucugaggaaugugccugcuagaucaaguagaggacuauuuggagccauagcugguuucauagagggagguuggucaggauuaguugcugguugguauggguuccagcauucaaaugaucaaggaaccgguauggcugcagauagagacucaacucaaaaggcaauugacaaaauaacguccaaaguaaauaauauagucgacaaaaugaacaaacaguaugaaauuauugaccaugaauucaacgagauugaaacuagacucaauaugaucaauaauaagauugaugaccaaauucaagacauaugggcauauaaugcugaauugcuaguacugcuugaaaaucaaaaaacucucgaugagcaugacgcaaauguaaacaaucuauauaacaaagugaagagggcacuggguuccaaugcaguggaagaugggaaaggaugcuucgaucuauaccauaaaugugauaaccagugcauggagacaauucgaaacgggaccuauaacaggagaaaguaucaggaggaaucaagacuagagagacagaaaauagagggggucaaacuggaaucugaaggaaccuacaaaauccucaccauuuauucgacugucgccucaucucuuguuauugcaaugggguucgcugccuucuuguucugggccauguccaauggaucuugcagaugcaacauuuguauauaa

SEQ ID NO: 40791 - RNA, 1683 nt, Artificial Sequence
  hemagglutinin__InfluenzaA__AGQ81136
auggaaacaauaucacuaaugacuauacuacugauaacgacagcaagcaaugcagauaaaaucugcaucggucaccagucaacaaacuccacagaaacuguggacacgcuaacagaaaccaauguuccugugacacaugccaaagaauugcuccaaacagagcacaauggaaugcugugugcgacaaaucuggggcauccccucauuuuagacacaugcacuaucgaaggacuaaucuauggcaaccccucuugugaccugcuauuggagggaagagaaugguccuacauagucgaaagacccucagcuguaaacggaacuuguuacccugggaauguagaaaaccuagaggaacucaggacacuuuuuaguuccgccaguuccuaccaaagaauccaaaucuucccagacacaauauggaauguuacuuacacuggaacaagcagaucauguucagguucauucuacaggaguaugagauggcugacucaaaaaagcggguuuuacccuguccaagacgccaaauacacaaauaacagggggaagaacauccucuucgugugggguauacaucacccacacaccuauaccgaccaaacaacuuuguacauaagaaacgacacaacaacaagugugacaacagaggaguugaauagaaucuucaaaccagugauagugccaaggcuucuugucaauggucagcaggggagaauugauuauuauuggucagugcuaaaaccaggccaaacauugcgaguaagauccaaugggaaucuaauugcuccaugguauggacacguucuuucaggagggagccauggaagaauccugaagacugacuuaaaaggugguaauuguguagugcaaugucaaacugaaaaggguggauucaacaguacauugcccuuccacaauaucagcaaauaugcauuuggaaccugccccaaauauguaaaagucaauagucucaaacuggcaauuggucugaggaaugugccugcuagaucaaauagaggacuauuuggggcuaucgcugguuucauagaaggagguuggccaggacuaguagcuggcugguaugguuuccagcauucaaaugaucaagggguugguauggccgcagauagggauucaacucaaaaggcaguugauaaaauaacaucuaaggugaauaauauagucgacaagaugaauaggcaauaugaaauaauugaucaugaguucagugagguugaaacuagacucaauaugaucaauaauaagauugaugaccaaauacaagacauauggacauauaaugcagaacugcuaguacuacuugaaaaccagaaaacgcucgaugagcaugaugcgaacguaaacaaucuauauaacaaggugaagagggcccugggcuccaaugcuauggaagaugggaaagguuguuucgaguuauaccauaagugugaugaucaaugcauggaaacaauucgaaacgggaccuauaauaggagaaaguauagagaggaaucaagauuagaacagcagagaauagaagggguuaaacuggaaucugagggaacuuacaaaauccucacuauuuauucgacugucgccucaucucuugugcuugcgaugggguuugcugccuuccuguucugggccauguccaaugguucuugcaggugcaacauuuguauauaa

SEQ ID NO: 40792 - RNA, 1683 nt, Artificial Sequence
  hemagglutinin__InfluenzaA__AGQ81137
auggaaacaauaucacuaaugacuauacuacugauaacgacagcaagcaaugcagauaaaaucugcaucggucaccagucaacaaacuccacagaaacuguggacacgcuaacagaaaccaauguuccugugacacaugccaaagaauugcuccaaacagagcacaauggaaugcugugugcgacaaaucuggggcauccccucauuuuagacacaugcacuaucgaaggacuaaucuauggcaaccccucuugugaccugcuauuggagggaagagaaugguccuacauagucgaaagacccucagcuguaaacggaacuuguuacccugggaauguagaaaaccuagaggaacucaggacacuuuuuaguuccgccaguuccuaccaaagaauccaaaucuucccagacacaauauggaauguuacuuacacuggaacaagcagaucauguucagguucauucuacaggaguaugagauggcugacucaaaaaagcggguuuuacccuguccaagacgccaaauacacaaauaacagggggaagaacauccucuucgugugggguauacaucacccacacaccuauaccgaccaaacaacuuuguacauaagaaacgacacaacaacaagugugacaacagaggaguugaauagaaucuucaaaccagugauagugccaaggcuucuugucaauggucagcaggggagaauugauuauuauuggucagugcuaaaaccaggccaaacauugcgaguaagauccaaugggaaucuaauugcuccaugguauggacacguucuuucaggagggagccauggaagaauccugaagacugacuuaaaaggugguaauuguguagugcaaugucaaacugaaaaggguggauucaacaguacauugcccuuccacaauaucagcaaauaugcauuuggaaccugcccuaaauauguaaaagucaauagucucaaacuggcgauuggucugaggaaugugccugcuagaucaaauagaggacuauuuggggcuaucgcugguuucauagaaggagguuggccaggacuaguagcuggcugguaugguuuccagcauucaaaugaucaagggguugguauggccgcagauagggauucaacucaaaaggcaguugauaaaauaacaucuaaggugaauaauauagucgacaagaugaauaggcaauaugaaauaauugaucaugaauucagugagguugaaacuagacucaauaugaucaauaauaagauugaugaccaaauacaagacauaugggcauauaaugcagaacugcuaguacuacuugaaaaccagaaaacgcucgaugagcaugaugcgaacguaaacaaucuauauaacaaggugaagagggcccugggcuccaaugcuauggaagaugggaaagguuguuucgaguuauaccauaagugugaugaucaaugcauggaaacaauucgaaacgggaccuauaauaggagaaaguauagagaggaaucaagauuagaacagcagagaauagaagggguuaaacuggaaucugagggaacuuacaaaauccucacuauuuauucgacugucgccucaucucuugugcuugcgaugggguuugcugccuuccuguucugggccauguccaaugguucuugcaggugcaacauuuguauauaa

SEQ ID NO: 40793 - RNA, 1683 nt, Artificial Sequence
  hemagglutinin__InfluenzaA__AGQ81138
auggaagcagcaacaauaauaacuauacuacuagcaauaacaggaagcaaugcggacaaaaucugcauuggcuaccaaucaacaaacuccacagaaacuguagacacgcuaaccgaaaacaacguuccugugacacaugcuaaagaauugcuucacacagagcacaaugggaugcuaugugcaacaaaccuggggcguccucuuauucuagacaccuguaccauugaaggauuaaucuauggcaacccuucuugugaucuaccgcuggaaggaagagaaugguccuacauugucgaaagaccaucagcuguuaauggagugugcuacccaggacacguagaaaaccuggaagaauuaaggucacuuuuuaguuccgcuaguucuuaccaaagaguccagaucuuuccagauucaaucuggaauguaucuuacaguggaacaagcaaagcauguucagauucauucuacagaagcaugaggugguuaacucaaaagaacaacaauuacccuguucaagacgcccaauacacaaauaauaaaggaaagaacauucuuuucauguggggcauaaaucacccacccacugauacugcacagacaaaucuguacacaaggacugacacaacaacaaguguggcgacggaagacauaaauaggaccuucaaaccauugauagggccaaggccucuugucaauggucuacaaggaaggauugauuauuauugggcgguguuaaaaccaggucagacauugcgaguaagauccaacgggaaucuaaucgcuccaugguauggacacauucucuuaggggagagucacggaagaauccugaaaacggauuuaaagagugguaacuguguagugcaaugucaaacagaaagaggugguuugaacacuacauugccauuucacaacgugagcaaguacgcauucggaaauugcccaaaauauauuggaguaaagagucucaaauuggcagucggucugaggaaugugcaugcuagaucaaguagaggacuauuuggagccauagcugguuucauagagggagguuggucaggauuaguugcugguugguauggguuccagcauucaaaugaucaaggaaccggaauggcugcagauagagacucaacucaaaaggcaauugacaaaauaacguccaaaguaaauaauauagucgacaaaaugaacaaacaguaugaaauuauugaccaugaauucagcgagauugaaacuagacucaauaugaucaaugauaagauugaugaccaaauucaagacauaugggcauauaaugcugaauugcuaguacugcuugaaaaucaaaaaacucucgaugagcaugacgcaaauguaaacaaucuauauaacaaagugaagagggcacuggguuccaaugcaguggaagaugggaaaggaugcuucgaucuauaccauaaaugcgauaaccagugcauggagacaauucgaaacgggaccuauaacaggagaaaguaucaggaggaaucaagacuagagagacagaaaauagagggggucaaacuggaaucugaaggaaccuacaaaauccucaccauuuauucgacugucgccucaucucuuguuauugcaaugggguucgcugccuucuuguucugggccaugucuaauggaucuugcagaugcaacauuuguauauaa

SEQ ID NO: 40794 - RNA, 1683 nt, Artificial Sequence
  hemagglutinin__InfluenzaA__AGQ81139
auggaaguagcaacaauaauaacuauacuacuaguaauaacaggaggcaaugcggauaaaaucugcauuggcuaucaaucaacaaacuccacagaaacuguagacacgcuaaccgaaaacaauguuccugugacacaugcuaaagaauugcuccacacagagcacaaugggaugcuaugugcaacaaaccuggggcguccucuuauucuagacaccuguaccauugaaggacuaaucuauggcaacccuucuugugaucuaccgcuggaagggagagaaugguccuacauugucgaaagaucaucggcuguuaauggagugugcuaccccggaaauguagaaaaccuagaagaauuaaggucacuuuuuaguuccgcuaguucuuaccaaagaauccagaucuuuccagauucaaucuggaaugugucuuacaguggaacaagcaaagcauguucagauucauucuacagaagcaugaggugguugacucaaaagaacaacaauuacccuguucaagacgcccaauacacaaauaauagaggaaagaacauucuuuucauguggggcauaaaucacccacccacugauaaugcacagacaaaucuauacacaaggacugacacaacaacaaguguggcgacggaagauauaaauaggaccuucaaaccauugauagggccaaggccucuugucaauggucuacaaggaaggauugauuauuauugggcgguguuaaaaccaggucagacauugcgaguaagauccaacgggaaucuaaucgcuccaugguauggacacauucucuuaggggagagucacggaagaauccugaaaacggauuuaaaaagugguaacuguguagugcaaugucaaacagaaagaggugguuugaacacuacauugccauuucacaacguaagcaaguacucauuuggaaauugcccaaaauauauuggaguaaagagucucaaauuggcagucggucugaggaaugugccugcuagaucaaguagaggacuauuuggagccauagcugguuucauagagggagguuggucaggauuaguugcugguugguauggguuccagcauucaaaugaucaaggaaccgguauggcugcagauagagacucaacucaaaaggcaauugacaaaauaacguccaaaguaaauaauauagucgacaaaaugaacaaacaguaugaaauuauugaccaugaauucagcgagauugaaacuagacucaauaugaucaauaauaagauugaugaccaaauucaagacauaugggcauauaaugcugaauugcuaguacugcuugaaaaucaaaaaacucucgaugagcaugacgcaaauguaaacaaucuauauaacaaagugaagagggcacuggguuccaaugcaguggaagaugggaaaggaugcuucgaucuauaccauaaaugugauaaccagugcauggagacaauucgaaacgggaccuauaacaggagaaaguaucaggaggaaucaagacuagagagacagaaaauagagggggucaaacuggaaucugaaggaaccuacaaaauccucaccauuuauucgacugucgccucaucucuuguuauugcaaugggguucgcugccuucuuguucugggccauguccaauggaucuugcagaugcaacauuuguauauaa

SEQ ID NO: 40795 - RNA, 1683 nt, Artificial Sequence
  hemagglutinin__InfluenzaA__AGQ81141
auggaagcagcaacaauaauaacuauacuacuaguaauaacaggaagcaaugcggauaaaaucugcauuggcuaccaaucaacaaacuccacagaaacuguagacacgcuaaccgaaaacaauguuccugugacacaugcgaaagaauugcuucacacagagcacaaugggaugcuaugugcaacagaccuggggcguccucuuauucuagacaccuguaccauugaaggauuaaucuauggcaacccuucuugugaucuaccgcuggaagggagagaaugguccuacauuguugaaagaccaucggcuguuaauggagugugcuacccuggaaauguagaaaaccuggaagaauuaaggucacuuuuuaguuccgcuaguucuuaccaaagaauccagaucuuuccagauucaaucuggaauguaucuuacaguggaacaagcaaagcauguucagauucauucuacagaagcaugaggugguugacucaaaagaacaacaauuauccuguucaagacgcccaauacacaaauaauagaggaaagaacauucuuuucaugugggguauaaaucacccacccacugauacugcacagacaaaucuguacacaaggacugacacaacaacaaguguggcgacggaagacauaaauagaaccuucaaaccauugauagggccaaggccucuugucaauggucuacaaggaaggauugauuauuauugggcgguguuaaaaccaggucagacauugcgaguaagauccaacgggaaucuaaucgcuccaugguauggacacauucucuuaggggagagucacggaagaauccugaaaacggauuuaaagagugguaacuguguagugcaaugucaaacagaaagaggugguuugaacacuacauugccauuucacaacgugagcaaguacgcauucggaaauugcccaaaauauauuggaguaaagagucucaaauuggcagucggucugaggaaugugccugcuagaucacguagaggacuauuuggagccauagcugguuucauagagggagguuggacaggauuaguugcugguugguauggguuccagcauucaaaugaucaaggaaccggaauggcugcagauagagacucaacucaaaaggcaauugacaaaauaacguccaaaguaaauaauauagucgacaaaaugaacaaacaguaugauauuauugaccaugaauucagcgagauugaaacuagacucaauaugaucaaugauaagauugaugaccaaauccaagacauaugggcauauaaugcugaauugcuaguacugcuugaaaaucaaaaaacucucgaugagcaugacgcaaauguaaacaaucuauauaacaaagugaagggggcacuggguuccaaugcaguggaagaugggaaaggaugcuucgaucuauaccauaaaugcgauaaccagugcauggagacaauucgaaacgggaccuauaacagaagaaaguaucaggaggaaucaagacuagagagacagaaaauagagggggucaaacuggaaucugaaggaaccuacaaaauccucaccauuuauucgacugucgccucaucucuuguuauugcaaugggguucgcugccuucuuguucugggccaugucuaauggaucuugcagaugcaacauuuguauauaa

SEQ ID NO: 40796 - RNA, 1683 nt, Artificial Sequence
  hemagglutinin__InfluenzaA__AGQ81143
auggaaguagcaacaauaauaacuauacuacuaguaauaacaggaagcaaugcggauaaaaucugcauuggcuaccaaucaacaaacuccacagaaacuguagacacgcuaaccgaaaacaauguuccugugacacaugcuaaagaauugcuccacacagagcacaaugggaugcuaugugcaacaaaccuggggcguccucuuauucuagacaccuguaccauugaaggacuaaucuauggcaacccuucuugugaucuaccgcuggaagggagagaaugguccuacauugucgaaagaccaucggcuguuaauggagugugcuaccccggaaauguagaaaaccuagaagaauuaaggucacuuuuuaguuccgcuaguucuuaccaaagaauccagaucuuuccagauucaaucuggaaugugucuuacaguggaacaagcaaagcauguucagauucauucuacagaagcaugaggugguugacucaaaagaacaacaauuacccuguucaagacgcccaauacacaaauaauagaggaaagaacauucuuuucauguggggcauaaaucacccacccacugauaaugcacagacaaaucuauacacaaggacugacacaacaacaaguguggcgacggaagauauaaauagaaccuucaaaccauugauagggccaaggccucuugucaauggucuacaaggaaggauugauuauuauugggcgguguuaaaaccaggucagacauugcgaguaagauccaacgggaaucuaaucgcuccaugguauggacacauucucuuaggggagagucacggaagaauccugaaaacggauuuaaaaagugguaacuguguagugcaaugucaaacagaaagaggugguuugaacacuacauugccauuucacaacguaagcaaguacucauuuggaaauugcccaaaauauauuggaguaaagagucucaaauuggcagucggucugaggaaugugccugcuagaucaaguagaggacuauuuggagccauagcugguuucauagagggagguuggucaggauuaguugcugguugguauggguuccagcauucaaaugaucaaggaaccgguauggcugcagauagagacucaacucaaaaggcaauugacaaaauaacguccaaaguaaauaauauagucgacaaaaugaacaaacaguaugaaauuauugaccaugaauucagcgagauugaaacuagacucaauaugaucaauaauaagauugaugaccaaauucaagacauaugggcauauaaugcugaauugcuaguacugcuugaaaaucaaaaaacucucgaugagcaugacgcaaauguaaacaaucuguauaacaaagugaagagagcacuggguuccaaugcaguggaagaugggaaaggaugcuucgaucuauaccauaaaugugauaaccagugcauggagacaauucgaaacgggaccuauaacaggagaaaguaucaggaggaaucaagacuagagagacagaaaauagagggggucaaacuggaaucugaaggaaccuacaaaauccucaccauuuauucgacugucgccucaucucuuguuauugcaaugggguucgcugccuucuuguucugggccauguccaauggaucuugcagaugcaacauuuguauauaa

SEQ ID NO: 40797 - RNA, 1683 nt, Artificial Sequence
  hemagglutinin__InfluenzaA__AGQ81144
auggaagcagcaacaauaauaacuauacuacuaguaguaacaggaagcaaugcagauaaaaucugcauuggcuaccaaucaacaaacuccacagaaacuguagacacacuaaccgaaaacaauguuccugugacacaugcuaaagaauugcuucacacagagcacaaugggaugcuaugugcaacaaaccuggggcguccucuuauucuagacaccuguaccauugaaggacuaaucuauggcaacccuucuugugaucuaccacuggaagggagagaaugguccuacauugucgaaagaccaucggcuguuaauggagugugcuaccccggaaauguagaaaaccuggaagaauuaaggucacuuuuuaguuccgcuaguucuuaccaaagaauccagaucuuuccagauucaaucuggaauguaucuuacgguggaacaagcaaagcauguucagauucauucuacaggagcaugaggugguugacucaaaagaacaacaauuauccuguucaagacgcccaauacacaaauaauagaggaaagaacauucuuuucauguggggcauaaaucacccacccacugauacugcacagacaaaucuguacacaaggacugacacaacaacaaguguggcgacggaagacauaaauaggaccuucaaaccauugauagggccaaggccucuugucaauggucuacaaggaaggauugauuauuauugggcggugcuaaaaccaggucagacauugcgaguaagauccaacgggaaucuaaucgcuccaugguauggacacauucucuuaggggagagucacggaagaauccugaaaacggauuuaaagagugguaauuguguagugcaaugucaaacagaaagaggugguuugaacacuacauugccauuucacaacgugagcaaguacgcauucggaaauugcccaaaauauauuggaguaaagagucucaaauuggcagucggucugaggaauaugccugcuagaucaaguagaggacuauuuggagccauagcugguuucauagagggagguuggucaggauuaguugcugguugguauggguuccagcauucaaaugaucaaggaaccggaauggcugcagauagagacucaacucaaaaggcaauugacaaaaucacguccaaaguaaauaauauagucgacaaaaugaacaaacaguaugaaauuauugaccaugaguucagcgagauugaaacuagacucaauaugaucaaugauaagauugaugaccaaauucaagacauaugggcauauaaugcugaauugcuaguacugcuugaaaaucaaaaaacucucgaugagcaugacgcaaauguaaacaaucuauauaacaaagugaagagggcacuggguuccaaugcaguggaagaugggaaaggaugcuucgaucuauaccauaaaugcgauaaccagugcauggagacaauucggaacgggaccuauaauagaagaaaguaucaggaggaaucaagacuagagagacagaaaauagagggggucaaacuggaaucugaaggaaccuacaaaauccucaccauuuauucgacugucgccucaucucuuguuauugcaaugggguucgcugccuucuuguucugggccaugucuaauggaucuugcagaugcaacauuuguauauaa

SEQ ID NO: 40798 - RNA, 1683 nt, Artificial Sequence
  hemagglutinin__InfluenzaA__AGQ81146
auggaagcagcaacaauaauaaccauacuacuaguaauaacaggaagcaaugcagauaaaaucuguauuggcuaccaaucaacaaacuccacagaaacuguagacacgcuaaccgaaaacaauguuccugugacacaugcuaaagaauugcuucacacagagcacaaugggaugcuaugugcaacaaaccuggggcguccucuuauucuggacaccuguaccauugaaggacuaaucuauggcaacccuucuugugaucuaccgcuggaagggaaagaaugguccuacauugucgaaagaccaucggcuguuaauggaaugugcuaccccggaaauguagaaaaccuggaagaauuaaggucacuuuuuaguuccgcuaguuccuaccaaagaauccagaucuuuccagauucaaucuggaauguaucuuacaguggaacaagcaaagcauguucagauucauucuacagaagcaugaggugguugacucaaaagaacaacaauuacccuguucaagacgcccaauacacaaauaauagaggaaaaaacauucuuuucauguggggcauaaaucacccacccacugacacugcacagacaaaucuguacacaaggacugacacaaaaacaaguguggcgacggaagaaauaaauaggaccuucaaaccauugauagggccaaggccucuugucaauggucuacaaggaaggauugauuauuauugggcgguguuaaaaccaggucagacauugcgaguaagauccaacgggaaucuaaucgcuccaugguauggacacauucucuuaggggagagucacggaagaauccugaaaacggauuuaaagagugguaauuguguagugcaaugucaaacagaaagagguggcuugaacacuacacugccauuucacaacgugagcaaguacgcauucggaaauugcccaaaauauauuggaguaaagagucucaaauuggcagucggucugaggaauguaccugcuagaucaaguagaggacuauuuggagccauagcugguuucauagagggagguuggucaggauuaguugcugguugguauggguuccagcauucaaaugaucagggaaccggaauggcugcagauagagacucaacucaaaaggcaauugacaaaauaacguccaaaguaaauaauauagucgacaaaaugaacaaacaguaugaaauuauugaccaugaauucagcgagauugaaacuagacucaauaugaucaaugauaagauugaugaccaaauucaagacauaugggcguauaaugcugaauugcuaguacugcuugaaaaucaaaaaacucucgaugagcaugacucaaauguaaacaaucuauauaacaaaguaaagagggcacuggguuccaaugcaguggaagaugggaaaggaugcuucgaucuauaccauaaaugcgauaaccagugcauggagacaauucgaaacgggaccuauaacagaagaaaguaucaggaggaaucaagacuagagagacagaaaauagagggggucaaacuggaaucugaaggaaccuacaaaauccucaccauuuauucgacugucgccucaucucuuguuauugcaaugggguucgcugccuucuuguucugggccaugucuaauggaucuugcagaugcaacauuuguauauaa

SEQ ID NO: 40799 - RNA, 1683 nt, Artificial Sequence
  hemagglutinin__InfluenzaA__AGQ81147
auggaagcagcaacaauaauaaccauacuacuaguaauaacaggaagcaaugcagauaaaaucuguauuggcuaccaaucaacaaacuccacagaaacuguagacacgcuaaccgaaaacaauguuccugugacacaugcuaaagaauugcuucacacagagcacaaugggaugcuaugugcaacaaaccuggggcguccucuuauucuggacaccuguaccauugaaggacuaaucuauggcaacccuucuugugaucuaccgcuggaagggaaagaaugguccuacauugucgaaagaccaucggcuguuaauggaaugugcuaccccggaaauguagaaaaccuggaagaauuaaggucacuuuuuaguuccgcuaguuccuaccaaagaauccagaucuuuccagauucaaucuggaauguaucuuacaguggaacaagcaaagcauguucagauucauucuacagaagcaugaggugguugacucaaaagaacaacaauuacccuguucaagacgcccaauacacaaauaauagaggaaagaacauucuuuucauguggggcauaaaucacccacccacugacacuguacagacaaaucuguacacaaggacugacacaaaaacaaguguggcgacggaagaaauaaauaggaccuucaaaccauugauagggccaaggccucuugucaauggucuacaaggaaggauugauuauuauugggcgguguuaaaaccaggucagacauugcgaguaagauccaacgggaaucuaaucgcuccaugguauggacacauucucuuaggggagagucacggaagaauccugaaaacggauuuaaagagugguaauuguguagugcaaugucaaacagaaagagguggcuugaacacuacacugccauuucacaacgugagcaaguacgcauucggaaauugcccaaaauauauuggaguaaagagucucaaauuggcagucggucugaggaauguaccugcuagaucaaguagaggacuauuuggagccauagcugguuucauagagggagguuggucaggauuaguugcugguugguauggguuccagcauucaaaugaucagggaaccggaauggcugcagauagagacucaacucaaaaggcaauugacaaaauaacguccaaaguaaauaauauagucgacaaaaugaacaaacaguaugaaauuauugaccaugaauucagcgagauugaaacuagacucaauaugaucaaugauaagauugaugaccaaauucaagacauaugggcauauaaugcugaauugcuaguacugcuugaaaaucaaaaaacucucgaugagcaugacgcaaauguaaacaaucuauauaacaaaguaaagagggcacuggguuccaaugcaguggaagaugggaaaggaugcuucgaucuauaccauaaaugcgauaaccagugcauggagacaauucgaaacgggaccuauaacagaagaaaguaucaggaggaaucaagacuagagagacagaaaauagagggggucaaacuggaaucugaaggaaccuacaaaauccucaccauuuauucgacugucgccucaucucuuguuauugcaaugggguucgcugccuucuuguucugggccaugucuaauggaucuugcagaugcaacauuuguauauaa

SEQ ID NO: 40800 - RNA, 1683 nt, Artificial Sequence
  hemagglutinin__InfluenzaA__AGQ81148
auggaagcagcaacaauaauaaccauacuacuaguaauaacaggaagcaaugcagauaaaaucuguauuggcuaccaaucaacaaacuccacagaaacuguagacacgcuaaccgaaaacaauguuccugugacacaugcuaaagaauugcuucacacagagcacaaugggaugcuaugugcaacaaaccuggggcguccucuuauucuggacaccuguaccauugaaggacuaaucuauggcaacccuucuugugaucuaccgcuggaagggaaagaaugguccuacauugucgaaagaccaucggcuguuaauggaaugugcuaccccggaaauguagaaaaccuggaagaauuaaggucacuuuuuaguuccgcuaguuccuaccaaagaauccagaucuuuccagauucaaucuggaauguaucuuacaguggaacaagcaaagcauguucagauucauucuacagaagcaugaggugguugacucaaaagaacaacaauuacccuguucaagacgcccaauacacaaauaauagaggaaagaacauucuuuucauguggggcauaaaucacccacccacugacacugcacagacaaaucuguacacaaggacugacacaaaaacaaguguggcgacggaagaaauaaauaggaccuucaaaccauugauagggccaaggccucuugucaauggucuacaaggaaggauugauuauuauugggcgguguuaaaaccaggucagacauugcgaguaagauccaacgggaaucuaaucgcuccaugguauggacacauucuauuaggggagagucacggaagaauccugaaaacggauuuaaagagugguaauuguguagugcaaugucaaacagaaagagguggcuugaacacuacacugcccuuucacaacgugagcaaguacgcauucggaaauugcccaaaauauauuggaguaaagagucucaaauuggcagucggucugaggaauguaccugcuagaucaaguagaggacuauuuggagccauagcugguuucauagagggagguuggucaggauuaguugcugguugguauggguuccagcauucaaaugaucagggaaccggaauggcugcagauagagacucaacucaaaaggcaauugacaaaauaacguccaaaguaaauaauauagucgacaaaaugaacaaacaguaugaaauuauugaccaugaauucagcgagauugaaacuagacucaauaugaucaaugauaagauugaugaccaaauucaagacauaugggcauauaaugcugaauugcuaguacugcuugaaaaucaaaaaacucucgaugagcaugacgcaaauguaaacaaucuauauaacaaaguaaagagggcacuggguuccaaugcaguggaagaugggaaaggaugcuucgaucuauaccauaaaugcgauaaccagugcauggagacaauucgaaacgggaccuauaacagaagaaaguaucaggaggaaucaagacuagagagacagaaaauagagggggucaaacuggaaucugaaggaaccuacaaaauccucaccauuuauucgacugucgccucaucucuuguuauugcaaugggguucgcugccuucuuguucugggccaugucuaauggaucuugcagaugcaacauuuguauauaa

SEQ ID NO: 40801 - RNA, 1683 nt, Artificial Sequence
  hemagglutinin__InfluenzaA__AGQ81149
auggaagcagcaacaauaauaacuauacuacuaguaauaacaggaagcaaugcggauaaaaucugcauuggcuaccaaucaacaaacuccacagaaacuguagacacgcuaaccgaaaacaauguuccugugacacaugcuaaagaauugcuucacacagggcacaaugggaugcuaugugcaacaaaccuggggcguccucuuauucuagacaccuguaccauugaaggacuaaucuauggcaacccuucuugugaucuaccgcuggaagggagagaaugguccuacauugucgaaagaccaucggcuauuaauggagugugcuaccccgggaauguagaaaaccuggaagaauugaggucacuuuuuaguuccgcuaguucuuaccaaagaauccagaucuuuccagauucaaucuggaauguaucuuacaguggaacaagcaaagcauguucagauucauucuacagaagcaugaggugguugacucaaaagaacaacaauuacccuguucaagacgcccaauacacaaauaauagaggaaagaacauucuuuucauguggggcauaaaucacccacccacugauacugcacagacaaaucuguacacaaggacugacacaacaacaaguguggcgacggaagacauaaauaggaccuucaaaccauugauagggccaaggccucuugucaauggucuacaaggaaggauugauuauuacugggcgguguuaaaaccaggucagacauugagaguaagauccaacgggaaucuaaucgcuccaugguauggacacauucuccuaggggagagucacggaagaauccugaaaacggauuuaaagagugguaacuguguagugcaaugucaaacagaaagaggugguuugaacacuacauugccauuucacaaugugagcaaguacgcauucggaaauugcccaaaauauauuggaguaaagagucucaaauuggcagucggucugaggaaugugccugcuagaucaaguagaggacuauuuggagccauagcugguuucauagagggagguuggucaggauuaguugcugguugguauggguuccaacauucaaaugaucaaggaaccggaauggcugcagauagagacucaacgcaaaaggcaauugacaaaauaacguccaaaguaaauaauauagucgacaaaaugaacaaacaguaugaaauuauugaccaugaauucagcgagauugaaacuagacucaauaugaucaaugauaagauugaugaccaaauucaagacauaugggcauauaaugcugaauugcuaguacugcuugaaaaucaaaaaacucucgaugagcaugacgcaaauguaaacaaucuauauaacaaaguuaagagggcacuugguuccaaugcaguggaagaugggaaaggaugcuucgaucuauaccauaaaugcgauaaccagugcauggagacaauucgaaacgggaccuauaacagaagaaaguaccaggaggaaucaagacuagagagacagaaaauagagggggucaaacuggaaucugaaggaaccuacaaaauccucaccauuuauucgacugucgccucaucucuuguuauugcaaugggguucgcugccuucuuguucugggccaugucuaaugguucuugcagaugcaacauuuguauauaa

SEQ ID NO: 40802 - RNA, 1683 nt, Artificial Sequence
  hemagglutinin__InfluenzaA__AGQ81150
auggaagcagcaacaauaauaacuauacuacuaguaauaacaggaagcaaugcggauaaaaucugcauuggcuaccaaucaacaaacuccacagaaacuguagacacgcuaaccgaaaacaauguuccugugacacaugcgaaagaauugcuucacacagagcacaaugggaugcuaugugcaacagaccuggggcguccucuuauucuagacaccuguaccauugaaggauuaaucuauggcaacccuucuugugaucuaccgcuggaagggagagaaugguccuacauuguugaaagaccaucggcuguuaauggagugugcuaccccggaaauguagaaaaccuggaagaauuaaggucacuuuuuaguuccgcuaguucuuaccaaagaauccagaucuuuccagauucaaucuggaauguaucuuacaguggaacaagcaaagcauguucagauucauucuacagaagcaugaggugguugacucaaaagaacaacaauuauccuguucaagacgcccaauacacaaaugauagaggaaauaacauucuuuucaugugggguauaaaucacccacccacugauacuguacagacaaaucuguacacaaggacugacacaacaacaaguguggcgacggaagacauaaauagaaccuucaaaccauugauagggccaaggccucuugucaauggucuacaaggaaggauugauuauuauugggcgguguuaaaaccaggucagacacugcgaguaagauccaacgggaaucuaaucgcuccaugguauggacacauucucuuaggggagagucacggaagaauccugaaaacggauuuaaagagugguaacuguguagugcaaugucaaacagaaagaggugguuugaacacuacauugccauuucacaacgugagcaaguacgcauucggaaauugcccaaaauauauuggaguaaagagucucaaauuggcagucggucugaggaaugugccugcuagaucaaguagaggacuauuuggagccauagcugguuucauagagggagguuggucaggauuaguugcugguugguauggguuccagcauucaaaugaucaaggaaccggaauggcugcagauagagacucaacucaaaaggcaauugacaaaauaacguccaaaguaaauaauauagucgacaaaaugaacaaacaguaugauauuauugaccaugaauucagcgagauugaaacuagacucaauaugaucaaugauaagauugaugaccaaauccaagacauaugggcauauaaugcugaauugcuaguacugcuugaaaaucaaaaaacucucgaugagcaugacgcaaauguaaacaaucuauauaacaaagugaagagggcacuggguuccaaugcaguggaagaugggaaaggaugcuucgaucuauaccauaaaugcgauaaccagugcauggagacaauucgaaacgggaccuauaacagaagaaaguaucaggaggaaucaagacuagagagacagaaaauagagggggucaaacuggaaucugaaggaaccuacaaaauccucaccauuuauucgacugucgccucaucucuuguuauugcaaugggguucgcugccuucuuguucugggccaugucuaauggaucuugcagaugcaacauuuguauauaa

SEQ ID NO: 40803 - RNA, 1683 nt, Artificial Sequence
  hemagglutinin__InfluenzaA__AGQ81152
auggaagcagcaacaauaauaacuauacuacuaguaauaacaggaagcaaugcggauaagaucugcauuggcuaccaaucaacaaacuccacagaaacuguagacacgcuaaccgaaaacaauguuccugugacacaugcuaaagaauugcuucacacagagcacaaugggaugcuaugugcaacaaaccuggggcguccucuuauucuagacaccuguaccauugaaggacuaaucuauggcaacccuucuugugaucuaccgcuggaagggagagacugguccuacauugucgaaagaccaucggcuguuaauggagugugcuaccccggaaauguagaaaaccuggaagaauuaaggucacuuuuuaguuccgcuaguucuuaccaaaaaauccagaucuuuccagauucaaucuggaauguaucuuacaguggaacaagcaaagcauguucagauucauucuacagaagcaugaggugguugacucaaaagaacaacaauuacccuguucaagacgcccaauacacaaauaauagaggaaagaacauucuuuuuauguggggcauaaaucacccacccacugauacuguacagacaaaucuguacacaaggacugacacaacaacaaguguggcgacggaagacauaaauaggaccuucaaaccauugauagggccaaggccucuuguuaauggucuacaaggaaggauugauuauuauugggcaguguuaaaaccaggucagacauugcgagugagauccaacgggaaccuaauugcuccaugguauggacacauucucuugggggagagucacggaagaauccugaaaacggauuuaaagagugguaacuguguagugcaaugucaaacagaaagaggugguuugaacacuacauugccauuucacaacgugagcaaguacgcauucggaaauugcccaaaauauauugggguaaagagucucaaauuggcagucggucugaggaaugugccugcuagaucaaguagaggacuauuuggagccauagcugguuuuauagagggagguuggucaggauuaguugcugguugguauggauuccagcauucaaaugaucaaggaaccggaauggcugcagauagagacucaacucagaaggcaauugacaaaauaacguccaaaguaaauaauauagucgacaaaaugaacaaacaguaugaaauuauugaccaugaauucagcgagauugaaacuagacucaauaugaucaaugauaagauugaugaccaaauucaagacauaugggcauauaaugcugaauuacuaguacugcuugaaaaucaaaaaacucucgaugagcaugacgcaaauguaaacaaucuauauaacaaagugaagagggcacuggguuccaaugcaguggaagaugggaaaggaugcuucgaucuauaccauaaaugcgauaaccagugcauggagacaauucgaaacgggaccuauaacagaagaaaguaucaggaggaaucaagauuagagagacagaaaauagagggggucaaacuggaaucugaaggaaccuacaaaauccucaccauuuauucgacugucgccucaucucuuguuauugcaaugggguucgcugccuucuuguucugggccaugucuaauggaucuugcagaugcaacauuuguauauaa

SEQ ID NO: 40804 - RNA, 1683 nt, Artificial Sequence
  hemagglutinin__InfluenzaA__AGQ81153
auggaagcagcaacaauaauaacuauacuacuaguaauaacaggaagcaaugcggauaaaaucugcauuggcuaccaaucaacaaacuccacagaaacuguagacacgcuaaccgaaaacaauguuccugugacacaugcuaaagaauugcuucacacagagcacaaugggaugcuaugugcaacaaaccuggggcguccucuuauucuagacaccuguaccauugaaggacuaaucuauggcaacccuucuugugaucuaccgcuggaagggagagacugguccuacauugucgaaagaccaucggcuguuaauggagugugcuaccccggaaauguagaaaaccuggaagaauuaaggucacuuuuuaguuccgcuaguucuuaccaaaaaauccagaucuuuccagauucaaucuggaauguaucuuacgguggaauaagcaaagcauguucaaauucauucuacagaagcaugaggugguugacucaaaagaacaacaauuacccuguucaagacgcccaauacacaaauaauagaggaaagaacauucuuuuuauguggggcauaaaucacccacccacuaauacuacacagacagaucuguacacaaggacugacacaacaacaaguguggcgacggaagacauacauaggaccuucaaaccauugauagggccaaggccucuuguuaauggucuacaaggaaggauugauuauuauugggcaguguuaaaaccaggucagacauugcgagugagauccaacgggaaccuaauugcuccaugguauggacacauucucuuggggaagagucacggaagaauccugaaaacggauuuaaagagugguaacuguguagugcaaugucaaacagaaagaggugguuugaacacuacauugccauuucacaacgugagcaaguacgcauucggaaauugcccaaaauauauugggguaaagagucucaaauuggcagucggucugaggaaugugccugcuagaucaaguagaggacuauuuggagccauagcugguuuuauagagggagguuggucaggauuaguugcugguugguauggauuccagcauucaaaugaucaaggaaccggaauggcugcagauagagacucaacucagaaggcaauugacaaaauaacguccaaaguaaauaauauagucgacaaaaugaacaaacaguaugaaauuauugaccaugaauucagcgagauugaaacuagacucaauaugaucaaugauaagauugaugaccaaauucaagacauaugggcauauaaugcugaauuacuaguacugcuugaaaaucaaaaaacucucgaugagcaugacgcaaauguaaacaaucuauauaacaaagugaagagggcacuggguuccaaugcaguggaagaugggaaaggaugcuucgaucuauaccauaaaugcgauaaccagugcauggagacaauucgaaacgggaccuauaacagaagaaaguaucaggaggaaucaagauuagagagacagaaaauagagggggucaaacuggaaucugaaggaaccuacaaaauccucaccauuuauucgacugucgccucaucucuuguuauugcaaugggguucgcugccuucuuguucugggccaugucuaauggaucuugcagaugcaacauuuguauauaa

SEQ ID NO: 40805 - RNA, 1683 nt, Artificial Sequence
  hemagglutinin__InfluenzaA__AGQ81155
auggaagcagcaacaauaauaacuauacuacuaguaauaacaggaagcaaugcggauaagaucugcauuggcuaccaaucaacaaacuccacagaaacuguagacacgcuaaccgaaaacaauguuccugugacacaugcuaaagaacugcuucacacagagcacaaugggaugcuaugugcaacaaaccuggggcguccucuuauucuagacaccuguaccauugaaggacuaaucuauggcaauccuucuugugaucuaccgcuggaagggagagacugguccuacauugucgaaagaccaucggcuguuaauggagugugcuaccccggaaauguagagaaccuggaagaauuaaggucacuuuuuaguuccgcuaguucuuaccaaaaaauccagaucuuuccagauucaaucuggaauguaucuuacaauggaacaagcaaagcauguucagauucauucuacagaagcaugaggugguugacucaaaagaacaacaauuacccuguucaagacgcccaauacacaaauaauagaggaaagaacauucuuuuuauguggggcauaaaucacccacccacugauacuacacagacaaaucuguacacaaggacugacacaacaacaaguguggcgacggaagacauaaauaggaccuucaaaccauugauagggccaaggccucuuguuaauggucuacaaggaaggauugauuauuauugggcaguguuaaaaccaggucagacauugcgagugagauccaacgggaaccuaauugcuccaugguauggacacauucucuugggggagagucacggaagaauccugaaaacggauuuaaagagugguaacuguguagugcaaugucaaacagaaagaggugguuugaacacuacauugccauuucacaacgugagcaaguacgcauucggagauugcccaaaauauauugggguaaagagucucaaauuggcagucggucugaggaaugugccugcuagaucaaguagaggacuauuuggagccauagcugguuuuauagagggagguuggucaggauuaguugcugguugguauggauuccagcauucaaaugaucaaggaaccggaauggcugcagauagagacucaacucagaaggcaauugacaaaauaacguccaaaguaaauaauauagucgacaaaaugaacaaacaguaugaaauuauugaccaugaauucagcgagauugaaacuagacucaauaugaucaaugauaagauugaugaccaaauucaagacauaugggcauauaaugcugaauuacuaguacugcuugaaaaucaaaaaacucucgaugagcaugacgcaaauguaaacaaucuauauaacaaagugaagagggcacuggguuccaaugcaguggaagaugggaaaggaugcuucgaucuauaccauaaaugcgauaaccagugcauggagacaauucgaaacgggaccuauaacagaagaaaguaucaggaggaaucaagauuagagagacaggaaauagagggggucaaacuggaaucugaaggaaccuacaaaauccucaccauuuauucgacugucgccucaucucuuguuauugcaaugggguucgcugccuucuuguucugggccaugucuaauggaucuugcagaugcaacauuuguauauaa

SEQ ID NO: 40806 - RNA, 1683 nt, Artificial Sequence
  hemagglutinin__InfluenzaA__AGQ81156
auggaagcagcaacaauaauaacuauacuacuaguaauaacaggaagcaaugcggauaaaaucugcauuggcuaccaaucaacaaacuccacagaaacuguagacacgcuaaccgaaaacaauguuccugugacacaugcuaaagaauugcuucacacagagcacaaugggaugcuaugugcaacaaaccuggggcguccucuuauucuagacaccuguaccauugaaggacuaaucuauggcaacccuucuugugaucuaccgcuggaagggagagacugguccuacauugucgaaagaccaucggcuguuaauggagugugcuaccccggaaauguagaaaaccuggaggaauuaaggucacuuuuuaguuccgcuaguucuuaccaaaaaauccagaucuuuccagauucaaucuggaauguaucuuacgguggaauaagcaaagcauguucaaauucauucuacagaagcaugaggugguugacucaaaagaacaacaauuacccuguucaagacgcccaauacacaaauaauagaggaaagaacauucuuuuuauguggggcauaaaucacccacccacuaauacuacacagacagaucuguacacaaggacugacacaacaacaaguguggcgacggaagacauacauaggaccuucaaaccauugauagggccaaggccucuuguuaauggucuacaaggaaggauugauuauuauugggcaguguuaaagccaggucagacauugcgagugagauccaacgggaaccuaauugcuccaugguauggacacauucucuugggggagagucacggaagaauccugaaaacggauuugaagagugguaacuguguagugcaaugucaaacagaaagaggugguuugaacacuacauugccauuucacaacgugagcaaguacgcauucggaaauugcccaaaauauauugggguaaagagucucaaauuggcagucggucugaggaaugugccugcuagaucaaguagaggacuauuuggagccauagcugguuuuauagagggagguuggucaggauuaguugcugguugguauggauuccagcauucaaaugaucaaggaaccggaauggcugcagauagagacucaacucagaaggcaauugacaaaauaacguccaaaguaaauaauauagucgacaaaaugaacaaacaguaugaaauuauugaccaugaauucagcgagauugaaacuagacucaauaugaucaaugauaagauugaugaccaaauucaagacauaugggcauauaaugcugaauuacuaguacugcuugaaaaucaaaaaacucucgaugagcaugacgcaaauguaaacaaucuauauaacaaagugaagagggcacuggguuccaaugcaguggaagaugggaaaggaugcuucgaucuauaccauaaaugcgauaaccagugcauggagacaauucgaaacgggaccuacaacagaagaaaguaucaggaggaaucaagauuagagagacagaaaauagagggggucaaacuggaaucugaaggaaccuacaaaauccucaccauuuauucgacugucgccucaucucuuguuauugcaaugggguucgcugccuucuuguucugggccaugucuaauggaucuugcagaugcaacauuuguauauaa

SEQ ID NO: 40807 - RNA, 1683 nt, Artificial Sequence
  hemagglutinin__InfluenzaA__AGQ81157
auggaagcagcaacaauaauaacuauacuacuaguaauaacaggaaacaaugcggauaagaucugcauuggcuaccaaucaacaaacuccacagaaacuguagacacgcuaaccgaaaacaauguuccugugacacaugcuaaagaacugcuucacacagagcacaaugggaugcuaugugcaacaaaccuggggcguccucuuauucuagacaccuguaccauugaaggacuaaucuauggcaauccuucuugugaucuaccgcuggaagggagagacugguccuacauugucgaaagaccaucggcuguuaauggagugugcuaccccggaaauguggagaaccuggaagaauuaaggucacuuuuuaguuccgcuaguucuuaccaaaaaauccagaucuuuccagauucaaucuggaauguaucuuacaauggaacaagcaaagcauguucagauucauucuacagaagcaugaggugguugacucaaaagaacaacaauuacccuguucaagacgcccaauacacaaauaauagaggaaagaacauucuuuuuauguggggcauaaaucacccacccacugauacuacacagacaaaucuguacacaaggacugacacaacaacaaguguggcgacggaagacauaaauaggaccuucaaaccauugauagggccaaggccucuuguuaauggucuacaaggaaggauugauuauuauugggcaguguuaaaaccaggucagacauugcgagugagauccaacgggaaccuaauugcuccaugguauggacacauucucuugggggagagucacggaagaauccugaaaacggauuuaaagagugguaacuguguagugcaaugucaaacagaaagaggugguuugaacacuacauugccauuucacaacgugagcaaguaugcauucggagauugcccaaaauauauugggguaaagagucucaaauuggcagucggucuaaggaaugugccugcuagaucaaguagaggacuauuuggagccauagcugguuuuauagagggagguuggucaggauuaguugcugguugguauggauuccagcauucaaaugaucaaggaaccggaauggcugcagauagagacucaacucagaaggcaauugacaaaauaacguccaaaguaaauaauauagucgacaaaaugaacaaacaguaugaaauuauugaccaugaauucagcgagauugaaacuagacucaauaugaucaaugauaagauugaugaccaaauucaagacauaugggcauauaaugcugaauuacuaguacugcuugaaaaucaaaaaacucucgaugagcaugacgcaaauguaaacaaucuauauaacaaagugaagagggcacuggguuccaaugcaguggaagaugggaaaggaugcuucgaucuauaccauaaaugcgauaaccagugcauggagacaauucgaaacgggaccuauaacagaagaaaguaucaggaggaaucaagauuagagagacagaaaauagagggggucaaacuggaaucugaaggaaccuacaaaauccucaccauuuauucgacugucgccucaucucuuguuauugcaaugggguucgcugccuucuuguucugggccaugucuaauggaucuugcagaugcaacauuuguauauaa

SEQ ID NO: 40808 - RNA, 1683 nt, Artificial Sequence
  hemagglutinin__InfluenzaA__AGQ81158
auggaaguaguaacaauaauaacuauacuacuaguaauaacaagaagcaaugcagauaaaauaugcauuggcuaccaaucaacaaacuccacagaaacuguagacacgcuaaccgaaaacaauguuccugugacacaugcuaaagaauugcuucacacagagcacaaugggaugcuaugugcaacaaaccuggggcguccucuuauucuagacaccuguaccauugaaggacuaaucuauggcaacccuucuugugaucuaccgcuggaagggagagaaugguccuacauugucgaaagaccaucggcuguaaauggagugugcuacccaggaaauguagaaaaccuagaagaauuaaggucacuuuuuaguuccgcuaguucuuaccaaagaauccagaucuuuccagauucaaucuggaauguaucuuacaguggaacaagcaaagcauguucagauucauucuacagaagcaugaggugguuaacucaaaagaacaacaauuacccuguucaagacgcccaauacacaaauaauagaggaaagaacauucuuuucauguggggcauaaaucacccacccacugauacugcacagacaaaucuguacacaaggacugacacaacaacaagcguagcgacggaagauauaaauaggaccuucaaaccauugauagggccaaggccucuuguuaauggucuacaaggaaggauugauuauuauugggcgguuuuaaaaccaggucagacacugcgaguaagauccaacgggaaucuaaucgcuccaugguauggacacauccuuuuaggggagagccacggaagaauccugaaaacggauuuaaagagugguagcuguguagugcaaugccaaacagaaagaggugguuugaacacuacauugccauuucacaacgugagcaaguacgcauuuggaaauugcccaaaauauauuggaguaaagagucucaaauuggcagucggucugaggaaugugccugcuagaucaaguagaggauuauuuggagccauagcugguuucauagagggagguuggucaggauuaguugcugguugguauggguuccagcauucaaaugaucaaggaacuggaauggcugcagauagagacucaacucaaaaggcaauugacaaaauaacguccaaaguaaauaauauagucgacaaaaugaacaaacaguaugaaauuauuaaccaugaauucagcgagauugaaacuagacucaauaugaucaaugauaagauugaugaccaaauucaagacauaugggcauauaaugcugaauugcuaguacugcuugaaaaucaaaaaacccucgaugagcaugacgcaaaugugaacaaucuuuauaacaaagugaagagggcacuggguuccaaugcaguggaagaugggaaaggaugcuucgaucuauaccauaaaugcgauaaccagugcauggagacaauucgaaacgggaccuauaacagaagaauguaucaggaggaaucaagacuagagaggcagaaaauagaaggggucaaacuggaaucugaaggaaccuacaaaauccucaccauuuauucgacugucgccucaucucuuguuauugcaaugggguucgcugccuucuuguucugggccaugucuaauggaucuugcagaugcaacauuuguauauaa

SEQ ID NO: 40809 - RNA, 1683 nt, Artificial Sequence
  hemagglutinin__InfluenzaA__AGQ81159
auggaagcagcaacaauaauaacuauacuacuaguaauaacaggaagcaaugcggauaaaaucugcauuggcuaccaaucaacaaacuccacagaaacuguagacacgcuaaccgaaaacaauguuccugugacacaugcuaaagaauugcuucacacagagcacaaugggaugcuaugugcaacaaaccuggggcguccucuuauucuagacaccuguaccauugaaggacuaaucuauggcaacccuucuugugaucuaccgcuggaagggagagacugguccuacauugucgaaagaccaucggcuguuaauggagugugcuaccccggaaauguagaaaaccuggaagaauuaaggucacuuuuuaguuccgcuaguucuuaccaaaaaauccagaucuuuccagauucaaucuggaauguaucuuacgauggaauaagcaaagcauguucaaauucauucuacagaagcaugaggugguugacuaaaaagaacaacaguuacccuguucaagacgcccaauacacaaauaauauaggaaagaacauucuuuuuauguggggcauaaaucacccacccacuaauacuacacagacagaucuguacacaaggacugacacaacaacaaguguggcaacggaagacauacauaggaccuucaaaccauugauagggccaaggccuccuguuaauggucuacuaggaaggauugauuauuauugggcaguguuaaagccaggucagacauugcgagugagauccaacgggaaccuaauugcuccaugguacggacacauucucuugggggagagucacggaagaauccugaaaacggauuugaagagugguaacuguguagugcaaugucaaacagaaagaggugguuugaacacuacauugccauuucacaacgugagcaaguacgcauucggaaauugcccaaaauauauugggguaaagagucucaaauuggcagucggucugaggaaugugccugcuagaucaaguagaggacuauuuggagccauagcugguuuuauagagggagguuggucaggauuaguugcugguugguauggauuccagcauucaaaugaucaaggaaccggaauggcugcagauagagacucaacucagaaggcaauugacaaaauaacguccaaaguaaauaauauagucgacaaaaugaacaaacaguaugaaauuauugaccaugaauucagcgagauugaaacuagacucaauaugaucaaugauaagauugaugaccaaauucaagacauaugggcauauaaugcugaauuacuaguacugcuugaaaaucaaaaaacucucgaugagcaugacgcaaauguaaacaaucuauauaacaaagugaagagggcacuggguuccaaugcaguggaagaugggaaaggaugcuucgaucuguaccauaaaugcgauaaccagugcauggagacaauucgaaacgggaccuauaacagaagaaaguaucaggaggaaucaagauuagagagacagaaaauagagggggucaaacuggaaucugaaggaaccuacaaaauccucaccauuuauucgacugucgccucaucucuuguuauugcaaugggguucgcugccuucuuguucugggccaugucuaauggaucuugcagaugcaacauuuguauauaa

SEQ ID NO: 40810 - RNA, 1683 nt, Artificial Sequence
  hemagglutinin__InfluenzaA__AGQ81161
auggagacaguaucacuaauaacuauacuacuaguagcaacaguaagcaaugcagauaaaaucugcaucggcuaucaaucaacaaacuccacagaaacuguggacacacuaacagaaaacaaugucccugugacacaugccaaagaacugcuccacacagagcauaaugggaugcugugugcaacaagcuugggacaaccucuuauuuuagacaccugcaccauugaagggcuaaucuauggcaauccuucuugugauccauugcuggaaggaagagaaugguccuauaucgucgagagaccaucagccguuaacggauuguguuaccccgggaauguagagaaucuagaagagcuaaggucacuuuuuaguucugcuaggucuuaucaaagaauccagauuuucccagacacaaucuggaaugugucuuacgaugggacaagcaaagcaugcucagguucauucuacagaaacaugagaugguugacucaaaagaacagcgauuacccuauucaagacgcccaauacacaaauaaucaagggaagaacauucuuuucauguggggcauaaaucacccacccaccgauacuacgcagagagaucuguacacgagaaccgacacaacaacgaguguggcaacagaagaaauaaauaggaucuucaaaccauugauuggaccaaggccucuugucaacgguuugaugggaagaauugauuauuauuggucgguauugaaaccgggucaaacacugcgaauaaaaucugaugggaaucuaauagcuccaugguauggacacauucuuucaggagagagccacggaagaauucugaagacugauuuaaaaaaggguagcugcacagugcaaugucagacagagaaagguggcuuaaacacaacauugccauuccaaaauguaaguaaguaugcauuuggaaacugcucaaaguacauuggcauaaagagucucaaacuugcaguuggucugaggaaugugccuucuagaucuaguagaggauuauucggggccauagcaggguuuauagagggagguuggucaggacuaguugcugguugguauggguuccagcauucaaaugaccaagggguugguauggcagcagauagagacucaacccaaaaggcaauugauaaaauaacauccaaagugaauaauauagucgacaaaaugaacaagcaguaugaaaucauugaucaugaauucagugagguagaaacuagacuuaacaugaucaauaauaagauugaugaucaaauccaggauauaugggcauauaaugcagaauugcuaguucugcuugaaaaccagaaaacacucgaugagcaugacgcaaauguaaacaaucuauauaauaaaguaaagagggcauuggguuccaaugcgguggaagaugggaaaggauguuucgagcuauaccacaaaugugaugaccaaugcauggagacaauucggaacgggaccuacaacagaaggaaguaucaagaggagucaaaauuagaaaggcagaaaauagagggggucaagcuggaaucugaaggaacuuacaaaauccucaccauuuauucgacugucgccucaucucuugugauugcaaugggguuugcugccuucuuguucugggccauguccaaugggucuugcagaugcaacauuuguauauaa

SEQ ID NO: 40811 - RNA, 1683 nt, Artificial Sequence
  hemagglutinin__InfluenzaA__AGQ81162
auggagacaguaucacuaauaacuauacuacuaguagcaacaguaagcaaugcagauaaaaucugcaucggcuaucaaucaacaaacuccacagaaacuguggacacacuaacagaaaacaaugucccugugacacaugccaaagaacugcuccacacagagcauaaugggaugcugugugcaacaagcuugggacaaccucuuauuuuagacaccugcaccauugaagggcuaaucuauggcaauccuucuugugaucuauugcuggaaggaagagaaugguccuauaucgucgagagaccaucagcuguuaacggauuguguuaccccgggaauguagagaaucuagaagagcuaaggucacuuuuuaguucugcuaggucuuaucaaagaauccagauuuucccagacacaaucuggaaugugucuuacgaugggacaagcaaagcaugcucagguucauucuacagaagcaugagaugguugacucaaaagaacagcgauuacccuauucaagacgcccaauacacaaauaaucaagggaagaacauucuuuucauguggggcauaaaucacccacccaccgauacuacgcagagggaucuguacacgagaaccgacacaacaacgaguguggcaacagaagaaauaaauaggaucuucaaaccauugauuggaccaaggccucuugucaacgguuugaugggaagaauugauuauuauuggucgguauugaaaccaggucaaacacugcgaauaaaaucugaugggaaucuaauagcuccaugguauggacacauucuuucaggagagagccacggaagaauucugaagacugauuuaaaaaaggguagcugcacagugcaaugucagacagagaaagguggcuuaaacacaacauugccauuccaaaauguaaguaaguaugcauuuggaaacugcucaaaguacaucggcauaaagagucucaaacuugcaguuggucugaggaaugugccuucuagaucuaguagaggauuauucggggccauagcaggguuuauagagggagguuggucaggacuaguugcugguugguauggguuccagcauucaaaugaccaagggguugguauggcagcagauagagacucaacccaaaaggcaauugauaaaauaacauccaaagugaauaauauagucgacaaaaugaacaagcaguaugaaaucauugaucaugaauucagugagguagaaacuagacuuaacaugaucaauaauaagauugaugaucaaauccaggauauaugggcauauaaugcagaauugcuaguucugcuugaaaaccagaaaacacucgaugagcaugacgcaaauguaaacaaucuauauaauaaaguaaagagggcguuggguuccaaugcgguggaagaugggaaaggauguuucgagcuauaccacaaaugugaugaccaaugcauggagacaauucggaacgggaccuacaacagaaagaaguaucaagaggagucaaaauuagaaagacagaaaauagagggggucaagcuggaaucugaaggaacuuacaaaauccucaccauuuauucgacugucgccucaucucuugugauugcaaugggguuugcugccuucuuguucugggccauguccaaugggucuugcagaugcaacauuuguauauaa

SEQ ID NO: 40812 - RNA, 1683 nt, Artificial Sequence
  hemagglutinin__InfluenzaA__AGQ81164
auggagacaguaucacuaauaacuauacuacuaguagcaacaguaagcaaugcagauaaaaucugcaucggcuaucaaucaacaaacuccacagaaacuguggacacacuaacagaaaacaaugucccugugacacaugccaaagaacugcuccacacagagcauaaugggaugcugugugcaacaagcuugggacaaccucuuauuuuagacaccugcaccauugaagggcuaaucuauggcaauccuucuugugaucuauugcuggaaggaagagaaugguccuauaucgucgagagaccaucagcuguuaacggauuguguuaccccgggaauguagagaaucuagaagagcuaaggucacuuuuuaguucugcuaggucuuaucaaagaauccagauuuucccagacacaaucuggaaugugucuuacgaugggacaagcaaagcaugcucagguucauucuacagaagcaugagaugguugacucaaaagaacagcgauuacccuauucaagacgcccaauacacaaauaaucaagggaagaacauucuuuucauguggggcauaaaucacccacccaccgauacuacgcagagagaucuguacacgagaaccgacacaacaacgaguguggcaacagaagaaauaaauaggaucuucaaaccauugauuggaccaaggccucuugucaacgguuugaugggaagaauugauuauuauuggucgguauugaaaccgggucaaacacugcgaauaaaaucugaugggaaucuaauagcuccaugguauggacacauucuuucaggagagagccacggaagaauucugaagacugauuuaaaaaaggguagcugcacagugcaaugucagacagagaaagguggcuuaaacacaacauugccauuccaaaauguaaguaaguaugcauuuggaaacugcucaaaguacauuggcauaaagagucucaaacuugcaguuggucugaggaaugugccuucuagaucuaguagaggauuauucggggccauagcaggguuuauagagggagguuggucaggacuaguugcugguugguauggguuccagcauucaaaugaccaagggguugguauggcagcagauagagacucaacccaaaaggcaauugauaaaauaacauccaaagugaauaauauagucgacaaaaugaacaagcaguaugaaaucauugaucaugaauucagugagguagaaacuagacuuaacaugaucaauaauaagauugaugaucaaauccaggauauaugggcauauaaugcagaauugcuaguucugcuugaaaaccagaaaacacucgaugagcaugacgcaaauguaaacaaucuauauaauaaaguaaagagggcguuggguuccaaugcgguggaagaugggaaaggauguuucgagcuauaccacaaaugugaugaccaaugcauggagacaauucggaacgggaccuacaacagaaggaaguaucaagaggagucaaaauuagaaagacagaaaauagagggggucaagcuggaaucugaaggaacuuacaaaauccucaccauuuauucgacugucgccucaucucuugugauugcaaugggguuugcugccuucuuguucugggccauguccaaugggucuugcagaugcaacauuuguauauaa

SEQ ID NO: 40813 - RNA, 1683 nt, Artificial Sequence
  hemagglutinin__InfluenzaA__AGQ81167
auggagacaguaucacuaauaacuauacuacuaguagcaacaguaagcaaugcagauaaaaucugcaucggcuaucaaucaacaaacuccacagaaacuguggacacacuaacagaaaacaaugucccugugacacaugccaaagaacugcuccacacagagcauaaugggaugcugugugcaacaagcuugggacaaccucuuauuuuagacaccugcaccauugaagggcuaaucuauggcaauccuucuugugaucuauugcuggaaggaagagaaugguccuauaucguugagagaccaucagcuguuaacggauuguguuaccccgggaauguagaaaaucuagaagagcuaaggucacuuuuuaguucugcuaggucuuaucaaagaauccagauuuucccagacacaauuuggaaugugucuuacaaugggacaagcaaagcaugcucagguucauucuacagaagcaugagaugguugacucaaaagaacagcaauuacccuauucaagacgcccaauacacaaauaaucaagggaagaacauucuuuucauguggggcauaaaucacccacccaccgauacuacgcagagagaucuguacacgagaaccgacacaacaacgaguguggcaacagaagaaauaaauaggaucuucaaaccauugauaggaccaaggccucuugucaacgguuugaugggaagaauugauuauuauuggucgguauugaaaccgggucaaacauugcgaauaaaaucugaugggaaucuaauagcuccaugguauggacacauucuuucaggagagagccacggaagaauucugaagacugauuuaaaaaaggguagcugcacagugcaaugucagacagagaaagguggcuuaaacacaacauugccauuccaaaauguaaguaaguaugcauuuggaaacugcucaaaauacauuggcauaaagagucucaaacuugcaguuggucugaggaaugugccuucuagaucuaguagaggacuauucggggccauagcaggguuuauagagggagguuggucaggacuaguugcugguugguauggguuccagcauucaaaugaccaagggguugguauggcggcagauagagacucaacccaaaaggcaauagauaaaauaacauccaaagugaauaauauagucgacaaaaugaacaagcaguaugaaaucauugaucaugaauucagugagguagaaacuagacuuaacaugaucaauaauaagauugaugaucaaauccaggauauaugggcauauaaugcagaauugcuaguucugcuugaaaaccagaaaacacucgaugagcaugacgcaaaugugaacaaucuauauaauaaaguaaagagggcguuggguuccaaugcgguggaagaugggaaagguuguuucgagcuauaccacaaaugugaugaccagugcauggagacaauucggaacgggaccuacaacagaaggaaguaucaagaggagucaaaauuagaaagacagaaaauagagggggucaaguuggaaucugaaggaacuuacaaaauccucaccauuuauucgacugucgccucaucucuugugauugcaaugggguuugcugccuucuuguucugggccauguccaaugggucuugcagaugcaacauuuguauauaa

SEQ ID NO: 40814 - RNA, 1683 nt, Artificial Sequence
  hemagglutinin__InfluenzaA__AGQ81168
auggagacaguaucacugauaacuauacuacuaguaguaacaguaagcaaugcagauaagaucugcaucggcuaucaaucaacaaacuccacagaaacuguagacacacuaacagaaaacaaugucccugugacacaugccagagaacugcuccacacagagcauaauggaaugcugugugcaacaagcuugggacacccucuuauucuagacaccuguaccauugaaggacuaaucuauggcaauccuucuugugaucuauuguugggaggaagagaaugguccuauaucgucgagagaccaucagcuguuaacggauuguguuaucccgggaauguagaaaaucuagaagagcuaaggucacuuuuuaguucugcuaggucuuaucaaaggauccagauuuucccagacacaaucuggaaugugucuuacagugggacaagcaaagcauguucagauucauucuacagaagcaugagaugguugacucaaaagggcaacgcuuacccuauucaagacgcccaauacacaaauaaucaaggaaagaacauucuuuucauguggggcauaaaucacccacccacugauacugcgcagacaaaucuguacacaagaaccgacacaacaacgaguguggcaacagaagagauaaauaggaccuucaaaccauugauaggaccaaggccucuugucaacgguuugaugggaagaauuaauuauuauuggucgguauuaaaaccgggucaaacacugcgaauaaaaucuaaugggaaucuaauagcuccaugguauggacacauucuuucaggagagagccacggaagaauccugaagacugauuuaaaaagggguagcugcacagugcagugucagacagagaaggguggcuuaaacacaacauugccauuccaaaaugugaguaaguaugcauuuggaaacugcucaaaauacauuggcaugaagagucucaaacuugcaguuggucugaggaaugugccuucuagaucuaguagaggacuauucggggccauagcaggauuuauagagggagguuggucaggacuaguugcugguugguauggauuccagcauucaaaugaccaaggaguugguauggcggcagauagagacucaacccaaaaggcaauugauaaaauaacauccaaagugaauaacauagucgacaaaaugaacaagcaguaugaaauuaucgaucaugaauucagcgagguugaaacuagacuuaacaugaucaauaauaagauugaugaucaaauccaagauauaugggcauauaaugcagaauugcuaguucugcuugaaaaccagaaaacacucgaugagcaugaugcaaauguaaacaaucuauacaauaaagugaagagggcguuggguuccaaugcgguggaagaugggaaaggauguuucgagcuauaccacaaaugugaugaccagugcauggagacaauucggaacgggaccuacaacagaaggaaguaucaagaggagucaaaauuagaaagacagaaaauagagggggucaagcuggaaucugaaggaacuuacaaaauccucaccauuuauucgacugucgccucaucucuugugauugcaaugggguuugcugccuucuuguucugggccauguccaaugggucuugcagaugcaacauuuguauauaa

SEQ ID NO: 40815 - RNA, 1683 nt, Artificial Sequence
  hemagglutinin__InfluenzaA__AGQ81169
auggagacaguaucacugauaacuauacuacuaguaguaacaguaagcaaugcagauaagaucugcaucggcuaucaaucaacaaacuccacagaaacuguagacacacuaacagaaaacaaugucccugugacacaugccagagaacugcuccacacagagcauaauggaaugcugugugcaacaagcuugggacacccucuuauucuagacaccuguaccauugaaggacuaaucuauggcaauccuucuugugaucuauuguugggaggaagagaaugguccuauaucgucgagagaccaucagcuguuaacggauuguguuaucccgggaauguagaaaaucuagaagagcuaaggucacuuuuuaguucugcuaggucuuaucaaaggauccagauuuucccagacacaaucuggaaugugucuuacagugggacaagcaaagcauguucagauucauucuacagaagcaugagaugguugacucaaaaggacaacgcuuacccuauucaagacgcccaauacacaaauaaucaagaaaagaacauucuuuucauguggggcauaaaucacccacccacugauacugugcagacaaaucuguacacaagaaccgacacaacaacgaguguggcaacagaagagauaaauaggaccuucaaaccauugauaggaccaaggccucuugucaacgguuugaugggaagaauuaauuauuauuggucgguauuaaaaccgggucaaacacugcgaauaaaaucuaaugggaaucuaauagcuccaugguauggacacauucuuucaggagagagccacggaagaauccugaagacugauuuaaaaagggguagcugcacagugcagugucagacagagaaggguggcuuaaacacaacauugccauuccaaaaugugaguaaguaugcauuuggaaacugcucaaaauacauuggcaugaagagucucaaacuugcaguuggucugaggaaugugccuucuagaucuaguagaggacuauucggggccauagcaggauuuauagagggagguuggucaggacuaguugcugguugguauggauuccagcauucaaaugaccaaggaguugguauggcggcagauagagacucaacccaaaaggcaauugauaaaauaacauccaaagugaauaacauagucgacaaaaugaacaagcaguaugaaauuaucgaucaugaauucagcgagguugaaacuagacuuaacaugaucaauaauaagauugaugaucaaauccaagauauaugggcauauaaugcagaauugcuaguucugcuugaaaaccagaaaacacucgaugagcaugaugcaaauguaaacaaucuauacaauaaagugaagagggcguuggguuccaaugcgguggaagaugggaaaggauguuucgagcuauaccacaaaugugaugaccagugcauggagacaauucggaacgggaccuacaacagaaggaaguaucaagaggagucaaaauuagaaagacagaaaauagagggggucaagcuggaaucugaaggaacuuacaaaauccucaccauuuauucgacugucgccucaucucuugugauugcaaugggguuugcugccuucuuguucugggccauguccaaugggucuugcagaugcaacauuuguauauaa

SEQ ID NO: 40816 - RNA, 1683 nt, Artificial Sequence
  hemagglutinin__InfluenzaA__AGQ81170
auggagacaguaucacugauaacuauacuacuaguaguaacaguaagcaaugcagauaagaucugcaucggcuaucaaucaacaaacuccacagaaacuguagacacacuaacagaaaacaaugucccugugacacaugccagagaacugcuccacacagagcauaauggaaugcugugugcaacaagcuugggacacccucuuauucuagacaccuguaccauugaaggacuaaucuauggcaauccuucuugugaucuauuguugggaggaagagaaugguccuauaucgucgagagaccaucagcuguuaacggauuguguuaucccgggaauguagaaaaucuagaagagcuaaggucacuuuuuaguucugcuaggucuuaucaaaggauccagauuuucccagacacaaucuggaaugugucuuacagugggacaagcaaagcauguucagauucauucuacagaagcaugagaugguugacucaaaaggacaacgcuuacccuauucaagacgcccaauacacaaauaaucaaggaaagaacauucuuuucauguggggcauaaaucacccacccacugauacugcgcagacaaaucuguacacaagaaccgacacaacaacgaguguggcaacagaagagauaaauaggaccuucaaaccauugauaggaccaaggccucuugucaacgguuugaugggaagaauuaauuauuauuggucgguauuaaaaccgggucaaacacugcgaauaaaaucuaaugggaaucuaauagcuccaugguauggacacauucuuucaggagagagccacggaagaauccugaagacugauuuaaaaagggguagcugcacagugcagugucagacagagaaggguggcuuaaacacaacauugccauuccaaaaugugaguaaguaugcauuuggaaacugcucaaaauacauuggcaugaagagucucaaacuugcaguuggucugaggaaugugccuucuagaucuaguagaggacuauucggggccauagcaggauuuauagagggagguuggucaggacuaguugcugguugguauggauuccagcauucaaaugaccaaggaguugguauggcugcagauagagacucaacccaaaaggcaauugauaaaauaacauccaaagugaauaacauagucgacaaaaugaacaagcaguaugaaauuaucgaucaugaauucagcgagguugaaacuagacuuaacaugaucaauaauaagauugaugaucaaauccaagauauaugggcauauaaugcagaauugcuaguucugcuugaaaaccagaaaacacucgaugagcaugaugcaaauguaaacaaucuauacaauaaagugaagagggcguuggguuccaaugcgguggaagaugggaaaggauguuucgagcuauaccacaaaugugaugaccagugcauggagacaauucggaacgggaccuacaacagaaggaaguaucaagaggagucaaaauuagaaagacagaaaauagagggggucaagcuggaaucugaaggaacuuacaaaauccucaccauuuauucgacugucgccucaucucuugugauugcaaugggguuugcugccuucuuguucugggccauguccaaugggucuugcagaugcaacauuuguauauaa

SEQ ID NO: 40817 - RNA, 1683 nt, Artificial Sequence
  hemagglutinin__InfluenzaA__AGQ81171
auggagacaguaucacugauaacuauacuacuaguaguaacaguaagcaaugcagauaagaucugcaucggcuaucaaucaacaaacuccacagaaacuguagacacacuaacagaaaacaaugucccugugacacaugccagagaacugcuccacacagagcauaauggaaugcugugugcaacaagcuugggacacccucuuauucuagacaccuguaccauugaaggacuaaucuauggcaauccuucuugugaucuauuguugggaggaagagaaugguccuauaucgucgagagaccaucagcuguuaacggauuguguuaucccgggaauguagaaaaucuagaagagcuaaggucacuuuuuaguucugcuaggucuuaucaaaggauccagauuuucccagacacaaucuggaaugugucuuacagugggacaagcaaagcauguucagauucauucuacagaagcaugagaugguugacucaaaaggacaacgcuuacccuauucaagacgcccaauacacaaauaaucaaggaaagaacauucuuuucauguggggcauaaaucacccacccacugauacugcgcagacaaaucuguacacaagaaccgacacaacaacgaguguggcaacagaagagauaaauaggaccuucaaaccauugauaggaccaaggccucuugucaacgguuugaugggaagaauuaauuauuauuggucgguauuaaaaccgggucaaacacugcgaauaaaaucuaaugggaaucuaauagcuccaugguauggacacauucuuucaggagagagccacggaagaauccugaagacugauuuaaaaagggguagcugcacagugcagugucagacagagaaggguggcuuaaacacaacauugccauuccaaaaugugaguaaguaugcauuuggaaacugcucaaaauacauuggcaugaagagucucaaacuugcaguuggucugaggaaugugccuucuagaucuaguagaggacuauucggggccauagcaggauuuauagagggagguuggucaggacuaguugcugguugguauggauuccagcauucaaaugaccaaggaguugggauggcggcagauagagacucaacccaaaaggcaauugauaaaauaacauccaaagugaauaacauagucgacaaaaugaacaagcaguaugaaauuaucgaucaugaauucagcgagguugaaacuagacuuaacaugaucaauaauaagauugaugaucaaauccaagauauaugggcauauaaugcagaauugcuaguucugcuugaaaaccagaaaacacucgaugagcaugaugcaaauguaaacaaucuauauaauaaagugaagagggcguuggguuccaaugcgguggaagaugggaaaggauguuucgagcuauaccacaaaugugaugaccagugcauggagacaauucggaacgggaccuacaacagaaggaaguaucaagaggagucaaaauuagaaagacagaaaauagagggggucaagcuggaaucugaaggaacuuacaaaauccucaccauuuauucgacugucgccucaucucuugugauugcaaugggguuugcugccuucuuguucugggccauguccaaugggucuugcagaugcaacauuuguauauaa

SEQ ID NO: 40818 - RNA, 1683 nt, Artificial Sequence
  hemagglutinin__InfluenzaA__AGQ81172
auggagacaguaucacugauaacuauacuacuaguaguaacaguaagcaaugcagauaagaucugcaucggcuaucaaucaacaaacuccacagaaacuguagacacacuaacagaaaacaaugucccugugacacaugccagagaacugcuccacacagagcauaauggaaugcugugugcaacaagcuugggacacccucuuauucuagacaccuguaccauugaaggacuaaucuauggcaauccuucuugugaucuauuguugggaggaagagaaugguccuauaucgucgagagaccaucagcuguuaacggauuguguuaucccgggaauguagaaaaucuagaagagcuaaggucacuuuuuaguucugcuaggucuuaucaaaggauccagauuuucccagacacaaucuggaaugugucuuacagugggacaagcaaagcauguucagauucauucuacagaagcaugagaugguugacucaaaaggacaacgcuuacccuauucaagacgcccaauacacaaauaaucaaggaaagaacauucuuuucauguggggcauaaaucacccacccacugauacugcgcagacaaaucuguacacaagaaccgacacaacaacgaguguggcaacagaagagauaaauaggaccuucaaaccauugauaggaccaaggccucuugucaacgguuugaugggaagaauuaauuauuauuggucgguauuaaaaccgggucaaacacugcgaauaaaaucuaaugggaaucuaauagcuccaugguauggacacauucuuucaggagagagccacggaagaauccugaagacugauuuaaaaagggguagcugcacagugcagugucagacagagaaggguggcuuaaacacaacauugccauuccaaaaugugaguaaguaugcauuuggaaacugcucaaaauacauuggcaugaagagucucaaacuugcaguuggucugaggaaugugccuucuagaucuaguagaggacuauucggggccauagcaggauuuauagagggagguuggucaggacuaguugcugguugguauggauuccagcauucaaaugaccaaggaguugguauggcggcagauagagacucaacccaaaaggcaauugauaaaauaacauccaaagugaauaacauagucgacaaaaugaacaagcaguaugaaauuaucgaucaugaauucagcgagguugaaacuagacuuaacaugaucaauaauaagauugaugaucaaauccaagauauaugggcauauaaugcagaauugcuaguucugcuugaaaaccagaaaacacucgaugagcaugaugcaaauguaaacaaucuauauaauaaagugaagagggcguuggguuccaaugcgguggaagaugggaaaggauguuucgagcuauaccacaaaugugaugaccagugcauggagacaauucggaacgggaccuacaacagaaggaaguaucaagaggagucaaaauuagaaagacagaaaauagagggggucaagcuggaaucugaaggaacuuacaaaauccucaccauuuauucgacugucgccucaucucuugugauugcaaugggguuugcugccuucuuguucugggccauguccaaugggucuugcagaugcaacauuuguauauaa

SEQ ID NO: 40819 - RNA, 1683 nt, Artificial Sequence
  hemagglutinin__InfluenzaA__AGQ81173
auggagacagcaucacugauaacuauacuacuaguaguaacaguaagcaaugcagauaagaucugcaucggcuaucaaucaacaaacuccacagaaacuguagacacacuaacagaaaacaaugucccugugacacaugccaaagaacugcuccacacagagcauaaugggaugcugugugcaacaagcuugggaaacccucuuauucuagacaccuguaccauugaaggacuaaucuauggcaauccuucuugugaucuauuguugggaggaagagaaugguccuauaucguugagagaccaucagcuguuaacggauuguguuaucccgggaauguagaaaaucuagaagagcuaaggucacuuuuuaguucugcuaggucuuaucaaaggauccagauuuucccagacacaaucuggaaugugucuuacagugggacaagcaaagcauguucagauucauucuacagaagcaugagaugguugacucaaaaggacaacgcuuacccuauucaagacgcccaauacacaaauaaucaaggaaagaacauucuuuucauguggggcauaaaucacccacccacugauacugcgcagacaaaucuguacacaagaaccgacacaacaacgaguguggcaacagaagagauaaauaggaccuucaaaccauugauaggaccaaggccucuugucaacgguuugaugggaagaauuaauuauuauuggucgguauuaaaaccgggucaaacacugcgaauaaaaucuaaugggaaucuaauagcuccaugguauggacacauucuuucaggagagagccacggaagaauccugaagacugauuuaaaaagggguagcugcacagugcagugucagacagagaaggguggcuuaaacacaacauugccauuccaaaaugugaguaaguaugcauuuggaaacugcucaaaauacauuggcaugaagagucucaaacuugcaguuggucugaggaaugugccuucuagaucuaguagaggacuauucggggccauagcaggauuuauagagggagguuggucaggacuaguugcugguugguauggauuccagcauucaaaugaccaagggguugguauggcggcagauagagacucaacccaaaaggcaauugauaaaauaacauccaaagugaauaacauagucgacaaaaugaacaagcaguaugaaauuaucgaucaugaauucagcgagguugaaacuagacuuaacaugaucaauaauaagauugaugaucaaauccaagauauaugggcauauaaugcagaauugcuaguucugcuugaaaaccagaaaacacucgaugagcaugaugcaaauguaaacaaucuauauaauaaagugaagagggcguuggguuccaaugcgguggaagaugggaaaggauguuucgagcuauaccacaaaugugaugaccagugcauggagacaauucgaaacgggaccuacaacagaaggaaguaucaagaggagucaaaauuagaaagacagaaaauagagggggucaagcuggaaucugaaggaacuuacaaaauucucaccauuuauucgacugucgccucaucucuugugauugcaaugggguuugcugccuucuuguucugggccauguccaaugggucuugcagaugcaacauuuguauauaa

SEQ ID NO: 40820 - RNA, 1683 nt, Artificial Sequence
  hemagglutinin__InfluenzaA__AGQ81175
auggagacaguaucacugauaacuauacuacuaguaguaacaguaagcaaugcagauaagaucugcaucggcuaucaaucaacaaacuccacagaaacuguagacacacuaacagaaaacaauguaccugugacacaugccagagaacugcuccacacagagcauaauggaaugcugugugcaacaagcuugggacacccucuuauucuagacaccuguaccauugaaggacuaaucuauggcaauccuucuugugaucuauuguugggaggaagagaaugguccuauaucgucgagagaccaucagcuguuaacggauuguguuaucccgggaauguagaaaaucuagaagagcuaaggucacuuuuuaguucugcuaggucuuaucaaaggauccagauuuucccagacacaaucuggaaugugucuuacagugggacaagcaaagcauguucagauucauucuacagaagcaugagaugguugacucaaaaggacaacgcuuacccuauucaagacgcccaauacacaaauaaucaaggaaagaacauucuuuucauguggggcauaaaucacccacccacugauacugcgcagacaaaucuguacacaagaaccgacacaacaacgaguguggcaacagaagagauaaauaggaccuucaaaccauugauaggaccaaggccucuugucaacgguuugaugggaagaauuaauuauuauuggucgguauuaaaaccgggucaaacacugcgaauaaaaucuaaugggaaucuaauagcuccaugguauggacacauucuuucaggagagagccacggaagaauccugaagacugauuuaaaaagggguagcugcacagugcagugucagacagagaaggguggcuuaaacacaacauugccauuccaaaaugugaguaaguaugcauuuggaaacugcucaaaauacauuggcaugaagagucucaaacuugcaguuggucugaggaaugugccuucuagaucuaguagaggacuauucggggccauagcaggauuuauagagggagguuggucaggacuaguugcugguugguauggauuccagcauucgaaugaccaaggaguugguauggcggcagauagagacucaacccaaaaggcaauugauaaaauaacauccaaagugaauaacauagucgacaaaaugaacaagcaguaugaaauuaucgaucaugaauucagcgagguugaaacuagacuuaacaugaucaauaauaagauugaugaucaaauccaagauauaugggcauauaaugcagaauugcuaguucugcuugaaaaccagaaaacacucgaugagcaugaugcaaauguaaacaaucuauauaauaaagugaagagggcguuggguuccaaugcgguggaagaugggaaaggauguuucgagcuauaccacaaaugugaugaccagugcauggagacaauucggaacgggaccuacaacagaaggaaguaucaagaggagucaaaauuagaaagacagaaaauagagggggucaagcuggaaucugaaggaacuuacaaaauccucaccauuuauucgacugucgccucaucucuugugauugcaaugggguuugcugccuucuuguucugggccauguccaaugggucuugcagaugcaacauuuguauauaa

SEQ ID NO: 40821 - RNA, 1683 nt, Artificial Sequence
  hemagglutinin__InfluenzaA__AGQ81177
auggagacaguaucacuaauaacuauacuacuaguagcaacaguaagcaaugcagauaaaaucugcaucggcuaucaaucaacaaacuccacagaaacuguggacacacuaacagaaaacaaugucccugugacacaugccaaagaacugcuccacacagagcauaaugggaugcugugugcaacaagcuugggacaaccucuuauuuuagacaccugcaccauugaagggcuaaucuauggcaauccuucuugugaucuauugcuggaaggaagagaaugguccuauaucgucgagagaccaucagcuguuaacggauuguguuaccccgggaauguagaaaaucuagaagagcuaaggucacuuuuuaguucugcuaggucuuaucaaagaauccagauuuucccagacacaaucuggaaugugucuuacaaugggacaagcaaagcaugcucagguucauucuacagaagcaugagaugguugacucgaaagaacggcgauuacccuauccaagacgcccaauacacaaauaaucaagggaagaacauucuuuucauguggggcauaaaucacccacccaccgauacuacgcagagagaucuguacacgagaaccgacacaacaacgaguguggcaacagaagaaauaaauaggaucuucaaaccauugauaggaccaaggccucuugucaacgguuugaugggaagaauugauuauuauuggucgguauugaaaccgggucaaacacugcgaauaaaaucugaugggaaucuaauagcuccaugguauggacacauucuuucaggagagagccacggaagaauucugaagacugauuuaaaaagggguagcugcacagugcaaugucagacagagaaagguggcuuaaacacaacauugccauuccaaaauguaaguaaguaugcauuuggaaacugcucaaaauacauuggcauaaagagucucaaacuugcaguuggucugaggaaugugccuucuagaucuaguagaggacuauucggggccauagcaggguuuauagagggagguuggucaggacuaguugcugguugguauggguuccagcauucaaaugaccaagggguugguauggcagcagauagagacucaacccaaaaggcaauugauaaaauaacauccaaagugaauaauauagucgacaaaaugaacaagcaguaugaaaucauugaucaugaauucagugagguagaaacuagacuuaacaugaucaauaauaagauugaugaucaaauccaggauauaugggcauauaaugcagaauugcuaguucugcuugaaaaccagaaaacacucgaugagcaugacgcaaauguaaacaaucuauauaauaaaguaaagagggcguuggguuccaaugcgguggaagaugggaaaggauguuucgagcuauaccacaaaugugaugaccaaugcauggagacaauucggaacgggaccuacaacagaaggaaguaucaagaggagucaaaauuagaaagacagaaaauagagggggucaagcuggaaucugaaggaacuuacaaaauccucaccauuuauucgacugucgccucaucucuugugauugcaaugggguuugcugccuucuuguucugggccauguccaaugggucuugcagaugcaacauuuguauauaa

SEQ ID NO: 40822 - RNA, 1683 nt, Artificial Sequence; identical to SEQ ID NO: 40821
  hemagglutinin__InfluenzaA__AGQ81178

SEQ ID NO: 40823 - RNA, 1683 nt, Artificial Sequence
  hemagglutinin__InfluenzaA__AGQ81181
auggagacaguaucacuaauaacuauacuacuaguagcaacaguaagcaaugcagauaaaaucugcaucggcuaucaaucaacaaacuccacagaaacuguggacacacuaacagaaaacaaugucccugugacacaugccaaagaacugcuccacacagagcauaaugggaugcugugugcaacaagcuugggacaaccucuuauuuuagacaccugcaccauugaagggcuaaucuauggcaauccuucuugugaucuauugcuggaagggagagaaugguccuauaucgucgagagaccaucagcuguuaacggauuguguuaccccgggaauguagagaaucuagaagagcuaaggucacuuuuuaguucugcuaggucuuaucaaagaauccagauuuucccagacacaaucuggaaugugucuuacaaugggacaagcaaagcaugcucagguucauucuacagaagcaugagaugguugacucaaaagaacagcaauuacccuauucaagacgcccaauacacaaauaaucaagggaagaacauucuuuucauguggggcauaaaucacccacccaccgacacuacgcagagagaucuguacacgagaaccgacacaacaacgaguguggcaacagaagaaauaaauaggaucuucaaaccauugauuggaccaaggccucuugucaacgguuugaugggaagaauugauuauuauuggucgguauugaaaccaggucaaacacugcgaauaaaaucugaugggaaucuaauagcuccaugguauggacacauucuuucaggagagagccacggaagaauucugaagacugauuuaaaaaaggguagcugcacagugcaaugucagacagagaaagguggcuuaaacacaacauugccauuccaaaauguaaguaaguaugcauuuggaaacugcucaaaguacauuggcauaaagagucucaaacuugcaguuggucugaggaaugugccuucuagaucuaguagaggauuauucggggccauagcaggguuuauagagggagguuggucaggacuaguugcugguugguauggguuccagcauucaaaugaccaagggguugguauggcagcagauagagacucaacccaaaaggcaauugauaaaauaacauccaaagugaauaauauagucgacaaaaugaacaagcaguaugaaaucauugaucaugaauucagugagguagaaacuagacuuaacaugaucaauaauaagauugaugaucaaauccaggauauaugggcauauaaugcagaauugcuaguucugcuugaaaaccagaaaacacucgaugagcaugacgcaaauguaaacaaucuauauaauaaaguaaagagggcguuggguuccaaugcgguggaagaugggaaaggauguuucgagcuauaccacaaaugugaugaccaaugcauggagacaauucggaacgggaccuacaacagaaggaaguaucaagaggagucaaaauuagaaagacagaaaauagagggggucaagcuggaaucugaaggaacuuacaaaauccucaccauuuauucgacugucgccucaucucuugugauugcaaugggguuugcugccuucuuguucugggccauguccaaugggucuugcagaugcaacauuuguauauaa

SEQ ID NO: 40824 - RNA, 1683 nt, Artificial Sequence; identical to SEQ ID NO: 40823
  hemagglutinin__InfluenzaA__AGQ81183

SEQ ID NO: 40825 - RNA, 1683 nt, Artificial Sequence; identical to SEQ ID NO: 40812
  hemagglutinin__InfluenzaA__AGQ81184

SEQ ID NO: 40826 - RNA, 1683 nt, Artificial Sequence
  hemagglutinin__InfluenzaA__AGQ81185
auggagacagcaucacuaauaacuauacuacuaguagcaacaguaagcaaugcagauaaaaucugcaucggcuaucaaucaacaaacuccacagaaacuguggacacacuaacagaaaacaaugucccugugacacaugccaaagaacugcuccacacagagcauaaugggaugcugugugcaacaagcuugggacaaccucuuauuuuagacaccugcaccauugaagggcuaaucuauggcaauccuucuugugaucuauugcuggaaggaagagaaugguccuauaucgucgagagaccaucagcuguuaacggauuguguuaccccgggaauguagaaaaucuagaagagcuaaggucacuuuuuaguucugcuaggucuuaucaaagaauccagauuuucccagacacaaccuggaaugugucuuacaaugggacaagcaaagcaugcucagguucauucuacagaagcaugagaugguugacucaaaagaacagcaauuacccuauccaagacgcccaauacacaaauaaucaagggaagaacauucuuuucauguggggcauaaaucacccacccaccgauacuacgcagagagaucuguacacgagaaccgacacaacaacgaguguggcaacagaagaaauaaauaggaucuucaaaccauugauaggaccaaggccucuugucaacgguuugaugggaagaauugauuauuauuggucgguauugaaaccgggucaaacacugcgaauaaaaucugaugggaaucuaauagcuccaugguauggacacauccuuucaggagagagccacggaagaauucugaagacugauuuaaagagggguagcugcacagugcaaugucagacagagaaagguggcuuaaacacaacauugccauuccaaaauguaaguaaguaugcauuuggaaacugcucaaaauacauuggcauaaagagucucaaacuugcaguuggucugaggaaugugccuucuagaucuaguagaggacuauucggggccauagcaggguuuauagagggagguuggucaggacuaguugcugguugguauggguuccagcauucaaaugaccaagggguugguauggcagcagauagagacucaacccaaaaggcaauugauaaaauaacauccaaagugaauaauauagucgacaaaaugaacaagcaguaugaaaucauugaucaugaauucagugagguagaaacuagacuuaauaugaucaauaauaagauugaugaucaaauccaggauauaugggcauauaaugcagaauugcuaguucugcuugaaaaccagaaaacacucgaugagcaugacgcaaauguaaacaaucuauauaauaaaguaaagagggcguuggguuccaaugcgguggaagaugggaaaggauguuucgagcuauaccacaaaugugauaaccaaugcauggagacaauucggaacgggaccuacaacagaaggaaguaucaagaggagucaaaauuagaaagacagaaaauagagggggucaagcuggaaucugaaggaacuuacaaaauccucaccauuuauucgacugucgccucaucucuugugauugcaaugggguuugcugccuucuuguucugggccauguccaaugggucuugcagaugcaacauuuguauauaa

SEQ ID NO: 40827 - RNA, 1683 nt, Artificial Sequence
  hemagglutinin__InfluenzaA__AGQ81186
auggagacaguaucacuaauaacuauacuacuaguagcaacaguaagcaaugcagauaaaaucugcaucggcuaucaaucaacaaacuccacagaaacuguggacacacuaacagaaaacaaugucccugugacacaugccaaagaacugcuccacacagagcauaaugggaugcugugugcaacaagcuugggacaaccucuuauuuuagacaccugcaccauugaagggcuaaucuauggcaauccuucuugugaucuauugcuggaaggaagagaaugguccuauaucgucgagagaccaucagcuguuaacggauuguguuaccccgggaauguagagaaucuagaagagcuaaggucacuuuuuaguucugcuaggucuuaucaaagaauccagauuuucccagacacaaucuggaaugugucuuacgaugggacaagcaaagcaugcucagguucauucuacagaagcaugagaugguugacucaaaagaacagcgauuacccuauucaagacgcccaauacacaaauaaucaagggaagaacauucuuuucauguggggcauaaaucacccacccaccgauacuacgcagagagaucuguacacgagaaccgacacaacaacgaguguggcaacagaagaaauaaauaggaucuucaaaccauugauuggaccaaggccucuugucaacgguuugaugggaagaauugauuauuauuggucgguauugaaaccaggucaaacacugcgaauaaaaucugaugggaaucuaauagcuccaugguauggacacauucuuucaggagagagccacggaagaauucugaagacugaucuaaaaaaggguagcugcacagugcaaugucagacagagaaagguggcuuaaacacaacauugccauuccaaaauguaaguaaguaugcauuuggaaacugcucaaaguacauuggcauaaagagucucaaacuugcaauuggucugaggaaugugccuucuagaucuaguagaggauuauucggggccauagcaggguuuauagagggagguuggucaggacuaguugcugguugguauggguuccagcauucaaaugaccaagggguugguauggcagcagauagagacucaacccaaaaggcaauugauaaaauaacauccaaagugaauaauauagucgacaaaaugaacaagcaguaugaaaucauugaucaugaauucagugagguagaaacuagacuuaacaugaucaauaauaagauugaugaucaaauccaggauauaugggcauauaaugcagaauugcuaguucugcuugaaaaccagaaaacacucgaugagcaugacgcaaauguaaacaaucuauauaauaaaguaaagagggcguuggguuccaaugcgguggaagaugggaaaggauguuucgagcuauaccacaaaugugaugaccaaugcauggagacaauucggaacgggaccuacaacagaaagaaguaucaagaggagucaaaauuagaaagacagaaaauagagggggucaagcuggaaucugaaggaacuuacaaaauccucaccauuuauucgacugucgccucaucucuugugauugcaaugggguuugcugccuucuuguucugggccauguccaaugggucuugcagaugcaacauuuguauauaa

SEQ ID NO: 40828 - RNA, 1683 nt, Artificial Sequence
  hemagglutinin__InfluenzaA__AGQ81190
auggagacaguaucacugauaacuauacuacuaguaguaacaguaagcaaugcagauaagaucugcaucggcuaucaaucaacaaacuccacagaaacuguagacacacuaacagaaaacaaugucccugugacacaugccagagaacugcuccacacagagcauaauggaaugcugugugcaacaagcuugggacacccucuuauucuagacaccuguaccauugaaggacuaaucuauggcaauccuucuugugaucuauuguugggaggaagagaaugguccuauaucgucgagagaccaucagcuguuaacggauuguguuaucccgggaauguagaaaaucuagaagagcuaaggucacuuuuuaguucugcuaggucuuaucaaaggauccagauuuucccagacacaaucuggaaugugucuuacagugggacaagcaaagcauguucagauucauucuacagaagcaugagaugguugacucaaaaggacaacgcuuacccuauucaagacgcccaauacacaaauaaucaaggaaagaacauucuuuucauguggggcauaaaucacccacccacugauacugcgcagacaaaucuguacacaagaaccgacacaacaacgaguguggcaacagaagagauaaauaggaccuucaaaccauugauaggaccaaggccucuugucaacgguuugaugggaagaauuaauuauuauuggucgguauuaaaaccgggucaaacacugcgaauaaaaucuaaugggaaucuaauagcuccaugguauggacacauucuuucaggagagagccacggaagaauccugaagacugauuuaaaaagggguagcugcacagugcagugucagacagagaaggguggcuuaaacacaacauugccauuccaaaaugugaguaaguaugcauuuggaaacugcucaaaauacauuggcaugaagagucucaaacuugcaguuggucugaggaaugugccuucuagaucuaguagaggacuauucggggccauagcaggauuuauagagggagguuggucaggacuaguugcugguugguauggauuccagcauucaaaugaccaaggaguugguauggcggcagauagagacucaacccaaaaggcaauugauaaaauaacauccaaagugaauaacauagucgacaaaaugaacaagcaguaugaaauuaucgaucaugaauucagcgagguugaaacuagacuuaacaugaucaauaauaagauugaugaucaaauccaagauauaugggcauauaaugcagaauugcuaguucugcuugaaaaccagaaaacacucgaugagcaugaugcaaauguaaacaaucuauacaauaaagugaagagggcguuggguuccaaugcgguggaagaugggaaaggauguuucgagcuauaccacaaaugugaugaccagugcauggagacaauucggaacgggaccuacaacagaaggaaguaucaagaggagucaaaauuagaaagacagaaaauagagggggucaagcuggaaucugaaggaacuuacaaaauccucaccauuuauucgacugucgccucaucucuugugauugcaaugggguuugcugccuucuuguucugggccauguccaaugggucuugcagaugcaacauuuguauauaa

SEQ ID NO: 40829 - RNA, 1683 nt, Artificial Sequence; identical to SEQ ID NO: 40817
  hemagglutinin__InfluenzaA__AGQ81191

SEQ ID NO: 40830 - RNA, 1683 nt, Artificial Sequence; identical to SEQ ID NO: 40821
  hemagglutinin__InfluenzaA__AGQ81192

SEQ ID NO: 40831 - RNA, 1683 nt, Artificial Sequence
  hemagglutinin__InfluenzaA__AGQ81193
auggagacaguaucacuaauaacuauacuacuaguagcaacaguaagcaaugcagauaaaaucugcaucggcuaucaaucaacaaacuccacagaaacuguggacacacuaacagaaaacaaugucccugugacacaugccaaagaacugcuccacacagagcauaaugggaugcugugugcaacaagcuugggacaaccucuuauuuuagacaccugcaccauugaagggcuaaucuauggcaauccuucuugugaucuauugcuggaaggaagagaaugguccuauaucgucgagagaccaucagcuguuaacggauuguguuaccccgggaauguagaaaaucuagaagagcuaaggucacuuuuuaguucugcuaggucuuaucaaagaauccagauuuucccagacacaaucuggaaugugucuuacacugggacaagcaaagcaugcucagguucauucuacagaagcaugagaugguugacucaaaagaacggcgauuacccuauccaagacgcccaauacacaaacaaucaagggaagaacauucuuuucauguggggcauaaaucacccacccaccgauacuacgcagagagaucuguacacgagaaccgacacaacaacgaguguggcaacagaagaaauaaauaggaucuucaaaccauugauaggaccaaggccucuugucaacgguuugaugggaagaauugauuauuauuggucgguauugaaaccgggucaaacacugcgaauaaaaucugaugggaaucuaauagcuccaugguauggacacguucuuucaggagagagccacggaagaauucugaagacugauuuaaaaagggguagcugcacagugcaaugucagacagagaaagguggcuuaaacacaacauugccauuccaaaauguaaguaaguaugcauuuggaaacugcucaaaauacauuggcauaaagagucucaaacuugcaguuggucugaggaaugugccuucuagaucuaguagaggacuauucggggccauagcaggguuuauagagggagguuggucaggacuaguugcugguugguauggguuccagcauucaaaugaccaagggguugguauggcagcagauagagacucaacccaaaaggcaauugauaaaauaacauccaaagugaauaauauagucgacaaaaugaacaagcaguaugaaaucauugaucaugaauucagugagguagaaacuagacuuaacaugaucaauaauaagauugaugaucaaauccaggauauaugggcauauaaugcagaauugcuaguccugcuugaaaaccagaaaacacucgaugagcaugacgcaaauguaaacaaucuauauaauaaaguaaagagggcguuggguuccaaugcgguggaagaugggaaaggauguuucgagcuauaccacaaaugugaugaccaaugcauggagacaauucggaacgggaccuacaacagaaggaaguaucaagaggagucaaaauuagaaagacagaaaauagagggggucaagcuggaaucugaaggaacuuacaaaauccucaccauuuauucgacugucgccucaucucuugugauugcaaugggguuugcugccuucuuguucugggccauguccaaugggucuugcagaugcaacauuuguauauaa

SEQ ID NO: 40832 - RNA, 1683 nt, Artificial Sequence; identical to SEQ ID NO: 40818
  hemagglutinin__InfluenzaA__AGQ81194

SEQ ID NO: 40833 - RNA, 1686 nt, Artificial Sequence
  hemagglutinin__InfluenzaA__AGQ81195
auguacaaaauaguagugauaaucacacuccuuggaacugugaagggucuugauaaaaucugccugggacaccaugcaguggccaaugggaccaucguaaagacucucacaaaugaacaggaagaggugaccaaugcuacugaaacaguggaggguaaaagccuaaacagauuauguaugaaaggaagaaaucauaaagaccugggcaacugccauccaauaggaaugcuaauagggacaccagcuugugaucugcaucuuacaggaacaugggacacucucauugaacgagagaaugcuauugcuuacugcuacccuggagcuacuauaaaugaggaagcacugaggcagaaaauaauggagaguggaggaaucagcaaaauaagcacuggauucacuuauggaucuuccauaaauucggccggaaccacuagagcaugcaugaggaauggagggaacagcuuuuaugcagagcuuaaguggcuaguaucaaagagcaaaggacaaaacuucccucagaccacgaacacuuacagaaacacagacacaucugaacaccucauaauguggggaauucaucaucccucuagcacccaagagaagaaugaucuauaugggacacaaucacuguccauaucggucgggaguuccacuuaucagaacaauuuuguuccgguuguuggagcaagaccucaggucaauggacaaaguggcagaaucgauuuucacuggacacuaguacaaccaggugauaauaucacuuucucacacaaugggggucugauagcaccgagccgaguuagcaaauugauuggaagaggauuggggauucagucagacgcaucaauagacaauaauugugaguccaaauguuuuuggagaggggguucuauaaauacaaggcuucccuuucaaaaucugucaccaagaacagugggucaauguccuaaauaugugaacaaaaggagcuugaugcuggcaacaggaaugagaaacgugccagaaauaaugcaagggagaggucuauuuggugcaauagcgggguuuauagagaaugggugggaaggaaugguagauggcugguaugguuucagacaccaaaaugcucagggcacaggccaagccgcugauuacaagaguacucaggcagcuauugaccaaaucacuggaaaacugaauagacuuauugaaaaaaccaauacugaguucgagucaauagaaucugaguucagugagauugaacaucagaucgguaacgucaucaauuggacuaaggauucaauaaccgacaucuggacuuaucaggcugagcuauugguagcaauggagaaccagcauacaaucgauauggcugauucagagauguugaaucuauaugaaagagugaggaaacaacucaggcagaaugcagaagaagacgggaaaggauguuuugaaauauaucaugcuugugaugacucaugcauggagagcauaagaaacaacaccuaugaccauucacaguacagagaagaagcucuuuugaacagacugaauaucaacccagugacacucucuucuggcuauaaagacaucauccucugguuuagcuucggggcaucauguuuuguucuucuagccguugucaugggucuugucuuuuucugccugaagaauggaaacaugcgaugcacaaucuguauuuag

SEQ ID NO: 40834 - RNA, 1686 nt, Artificial Sequence
  hemagglutinin__InfluenzaA__AGQ81196
auguacaaaauaguaguaauaaucgcgcuccuuggagcugugaaaggucuugacaaaaucugccuaggacaucaugcgguggccaaugggaccaucguaaagacucucacaaacgaacaggaggaagugaccaaugcuacugaaacaguggagagugcaagccuaaacagguuauguaugaaaggaagaagccauaaagaccugggcaacugccauccaauaggaauguugauaggaacaccagcuugugaucugcaucuuacagggacaugggacacucucauugaacgagagaaugcuauugcuuacugcuacccuggagcaaccguaaaugaagaagcacugaggcagaaaauaauggagagugggggaaucagcaaaauuagcacuggcuucacuuaugggucuuccauaaauucggccggaaccacuaaagcaugcaugaggaauagagggaauagcuuuuacgcagagcucaaguggcugguaucaaagagcaaaggacaaaacuucccccagaccacgaacacuuacagaaacacggauacggcugaacaucucauaauguggggaauucaucacccuucuagcacucaagagaagaaugaucuauaugggacacaaucauuguccauaucgguugggaguuccacuuaccagaacaauuuuguuccgguuguuggggcaaggccccaagucaauggacaaagcggaagaaucgauuuucacuggacacuaguacagccaggugauaauaucaccuucucacacaaugggggucugauagcaccgagucgaguuaguaaauugguuggaagaggauuggggauucaaucagacgcaccaauagacaauaauugugagucuaaauguuuuuggagaggggguucuauaaauacaagacucccuuuccaaaauuugucaccaagaacagugggccaauguccuaaauacgugaacaaaaggagcuugaugcuugcaacaggaaugagaaaugugccagaaauaaugcaagggagaggucuauuuggugcaauagcgggauuuauagagaauggaugggaaggaaugguagaugguugguacgguuucagacaccaaaacgcucagggcacaggccaagccgccgacuacaagaguacucagacagccauugaccagaucacuggaaaacugaauagacuuauugagaaaaccaacacugaguuugaaucaauagaaucugaauucagugagaucgaacaccaaaucgggaacgucaucaauuggacuaaggauucaauaacugacaucuggacuuaucaggcugagcuauugguagcaauggagaaccagcacacaaucgauauggcugacucagagauguuaaaucuauaugagagagugaggaaacaacucaggcagaaugcugaagaggacggaaaaggauguuuugagauauaucaugcuugugaugacucaugcauggagagcauaagaaacaacaccuaugaucauucacaauacagagaagaggcucuuuugaacagacugaauaucaauccagugaaacucucuuccggcuauaaagacaucauccuuugguuuagcuucggggcaucauguuuuguucuucuagccguugucaugggucuuguuuucuucugucugaagaauggaaacaugcgaugcacaaucuguauuuag

SEQ ID NO: 40835 - RNA, 1686 nt, Artificial Sequence
  hemagglutinin__InfluenzaA__AGQ81198
auguacaaaauaguagugauaaucgcgcuccuuggagcugugaagggucuugauaaaaucugccugggacaucaugcaguggccaaugggaccaucguaaagacccucacaaaugaacaggaagaggugaccaaugcuacugaaacaguggagaguacaagccuaaacagauuauguaugaaaggaagaaaccauaaagaccugggcaacugccauccaauaggaaugcuaauagggacaccagcuugugaucugcaucuuacagggacgugggacacucucauugaacgagagaaugcuauugcuuacugcuacccuggagcuacuauaaaugaagaagcacugaggcagaaaauaauggagaguggaggaaucagcaaaauaagcacuggauucacuuauggaucuuccauaaauucggcuggaaacacuaaagcaugcaugaggaauggagggaauagcuuuuaugcagagcuuagguggcugguaucaaagaacaaaggacaaaacuucccucagaccacgaacacuuacagaaacacagacacggcugaacaccucauaauauggggaauucaucaucccucuagcacuaaagagaagaaugaucuauaugggacacaaucacuguccauaucggucgggaguuccacuuaccagaacaauuuuguuccgguuguuggagcaagaccucaggucaauggacaaaguggcagaaucgauuuucacuggacacuuguacagccaggugauaauaucaccuucucacacaaugggggucugauagcaccgagccgaguuagcaaauugauuggaagaggauuggggauucaaucagacgcaccaauagacaauaauugugaguccaaauguuuuuggagaggggguucuauaaauacaaggcuucccuuucaaaauuugucaccaagaacagugggucaauguccuaaauaugugaacaaaaagagcuugaugcuugcaacaggaaugagaaacgugccagaaauaaugcaagggagaggucuauuuggugcaauagcgggguuuauagagaaugggugggaaggaaugguagauggcugguaugguuucagacaccaaaaugcucagggcacaggccaagccgcugauuacaagaguacucaggcagcuauugaccaaaucacuggaaaacugaauagacuuauugaaaaaaccaauacugaguucgagucaauagaaucugaguucagugagaucgaacaccagaucgguaacgucaucaauuggacuaaggauucaauaaccgacaucuggacuuaucaggcugagcuauugguagcaauggagaaccagcauacaaucgauauggcugauucagagauguugaaucuauaugaaagagugaggaaacaacucaggcagaaugcagaagaagacgggaaaggauguuuugaaauauaucaugcuugugaugacucaugcauggagagcauaagaaacaacaccuaugaccauucacaguacagagaagaagcucuuuugaacagacugaauaucaacccagugacacucucuucuggcuauaaagacaucauccucugguuuagcuucggggcaucauguuuuguucuucuagccguugucaugggucuugucuucuucugucugaagaauggaaacaugcgaugcacaaucuguauuuag

SEQ ID NO: 40836 - RNA, 1686 nt, Artificial Sequence
  hemagglutinin__InfluenzaA__AGQ81199
auguacaaaauaguaguaauaaucgcgcuccuuggagcugugaaaggucuugacaaaaucugccuaggacaucaugcgguggccaaugggaccaucguaaagacucucacaaacgaacaggaggaagugaccaaugcuacugaaacaguggagagugcaagccuaaacagguuauguaugaaaggaagaagccauaaagaccugggcaacugccauccaauaggaauguugauaggaacaccagcuugugaucugcaucuuacagggacaugggacacucucauugaacgagagaaugcuauugcuuacugcuacccuggagcaaccguaaaugaagaagcacugaggcagaaaauaauggagagugggggaaucagcaaaauuagcacuggcuucacuuaugggucuuccauaaauucggccggaaccacuaaagcaugcaugaggaauggagggaauagcuuuuacgcagagcucaaguggcugguaucaaagagcaaaggacaaaacuucccccagaccacgaacacuuacagaaacacggauacggcugaacaucucauaauguggggaauucaucacccuucuagcacucaagagaagaaugaucuauaugggacacaaucauuguccauaucgguugggaguuccacuuaccagaacaauuuuguuccgguuguuggggcaaggccccaagucaauggacaaagcggaagaaucgauuuucacuggacacuaguacagccaggugauaauaucaccuucucacacaaugggggucugauagcaccgagucgaguuaguaaauugguuggaagaggauuggggauucaaucagacgcaccaauagacaauaauugugagucuaaauguuuuuggagaggggguucuauaaauacaagacucccuuuccaaaauuugucaccaagaacagugggccaauguccuaaauacgugaacaaaaggagcuugaugcuugcaacaggaaugagaaaugugccagaaauaaugcaagggagaggucuauuuggugcaauagcgggauuuauagagaauggaugggaaggaaugguagaugguugguacgguuucagacaccaaaacgcucagggcacaggccaagccgccgacuacaagaguacucagacagccauugaccagaucacuggaaaacugaauagacuuauugagaaaaccaacacugaguuugaaucaauagaaucugaauucagugagaucgaacaccaaaucgggaacgucaucaauuggacuaaggauucaauaacugacaucuggacuuaucaggcugagcuauugguagcaauggagaaccagcacacaaucgauauggcugacucagagauguuaaaucuauaugagagagugaggaaacaacucaggcagaaugcugaagaggacggaaaaggauguuuugagauauaucaugcuugugaugacucaugcauggagagcauaagaaacaacaccuaugaucauucacaauacagagaagaggcucuuuugaacagacugaauaucaauccagugaaacucucuuccggcuauaaagacaucauccuuugguuuagcuucggggcaucauguuuuguucuucuagccguugucaugggucuuguuuucuucugucugaagaauggaaacaugcgaugcacaaucuguauuuag

SEQ ID NO: 40837 - RNA, 1698 nt, Artificial Sequence
  hemagglutinin__InfluenzaA__AGQ81200
augaagaaaacacugcuauuugcagcuauuuuccuuuauguaaaggcagaugaaaucugcaucggcuauuuaagcaacaacucaacggacaagguugacacaauaaucgagaacaaugucacgguaacuagcucaguggaacuagucgaaacagaacacacuggaucauucuguucaaucaaugggaaacaaccaauaggccuuggagauugcuccuucgcuggguggauauuggggaaucccaugugugaugaccuaauugguaagacuucauggucuuacaucguggagaagcccaacccagcaaacggaaucuguuacccaggaacauuagagaaugaagaggaacugagauugaaauucaguggaguccuggaauucagcaaauucgaagcauucacaucaaccggauggggugcuguaaauucaggagcaggagugacugcugcauguaaguuugggagcuccaauuccuucuuccgaaacaugguauggcugauacaccaaucaggaacauacccuguaauaaagaggaccuucaacaacaccaaaggaagagauguguugguuguuuggggaauucaccacccugccacacugaaagagcaucaggaccuauauaagaaagacagcuccuauguagcaguggguucagaaaccuacaacaggagauucauaccagaaaucagcacuaggcccaaaguuaauggacaggcuggaaggaugacauuuuauuggacaauagucaaaccaggggagucaauaacauuugaaucuaauggugcauuccuggcuccuagauaugcuuuugaaauugucucuguuggaaaugggaaacuauucaggagugaacugaauauugaaucaugcucuaccaaaugucaaacggaaauaggaggaauuaauacaaacaaaagcuuucacaguguucauagaaacacuaucggagacugucccaaauaugugaaugucaaaucuuuaaagcuugccacgggacucagaaaugucccagcaauagcaucaagaggguuauuuggagcaauagccggguuuauagaagguggauggccuggacugaucaauggaugguacggguuucaacacagaaaugaagaaggaacagguauagcagcagacaaggagucaacucagaaggcaauagaccagauaacguccaaaguaaauaauaucgucgacaagaugaauacaaauuucgagucugugcaacacgaauucagugaaauagaggagaggauaaaccaauugucgaaacauguagaugacucuguaguugacaucuggucauauaaugcacaacuccucguuuugcuugaaaaugagaagacccuggaccuccacgauuccaaugucagaaaucuccaugagaagguuaggaggaugcuaaaggacaaugccaaagaugaggggaacggauguuucaccuuuuaccauaagugugauaacgaaugcauugaaaggguuagaaacgggacauacgaucacaaagaauucgaggaagaaucuaaaaucaaucgucaggagaucgagggagugaaauuagacuccagugggaauguauauaaaauacugucaauuuacagcugcauugcaagcagucucguauuggcagcacucaucauggguuucauccucugggcgugcaguaauggaucauguagauguaccauuugcauuuaa

SEQ ID NO: 40838 - RNA, 1698 nt, Artificial Sequence
  hemagglutinin__InfluenzaA__AGQ81202
augaagaaaacacugcuauuugcagcuauuuuccuuuaugugaaggcagaugaaaucugcaucggcuauuuaagcaacaacucaacagacaagguugacacaauaaucgagaacaaugucacggugacuagcucaguggaacuagucgaaacagaacacacuggaucauucuguucaaucaaugggaaacaaccaauaagucuuggagauugcuccuucgcuggguggauauuggggaaucccaugugugaugaccuaauugguaagacuucauggucuuacaucguggagaagcccaacccagcaaacgggaucuguuacccaggaacauuggagaaugaagaggaacugagauugaaauucaguggaguccuggaauucagcaaauucgaagcauucacaucaaacggauggggugcuguaaauucaggggcaggagugacugcugcauguaaguuugggagcuccaauuccuucuuccgaaacacgguauggcugauacaccaaucaggaacauacccuguaauaaagaggaccuucaacaacaccaaaggaagagauguguugguuguuuggggaguucaccacccugccacacugaaagagcaucaggaccuauacaagaaagacagcuccuauguagcaguggguucggaaaccuacaacaggagauucauaccagaaaucagcacuaggcccaaaguuaauggacaggcuggaaggaugacauuuuauuggacaauagucaaaccaggggaaucaauaacauuugaaucuaauggugcauuccuggcuccuagauaugcuuuugagauugucucuguuggaaaugggaaacuauucaggagugaacugaauauugaaucaugcucuaccaaaugucaaacggaaauaggaggaauuaauacaaacaaaagcuuucacaguguucauagaaacacuaucggagacugucccaaauaugugaaugucaaaucuuuaaagcuugccacgggacucagaaaugucccagcaauagcaucaagaggcuuguuuggagcaauagccggguuuauagaagguggauggccuggacugaucaauggaugguacggguuucaacacaggaaugaagaaggaacaggaauagcagcagacaaggagucaacucagaaggcaauagaccagauaacguccaaaguaaacaauaucgucgacagaaugaauacaaauuucgaaucugugcaacacgaguccagugaaauagaggagaggauaaaccaauugucgaaacauguagaugauucuaugguugacaucuggucauauaaugcacaacuccuuguuuugcuugaaaaugagaagacccuggaucuccaugauuccaaugucagaaaucuccaugagaagguuaggaggaugcuaaaggacaaugccaaagaugaggggaacggauguuucaccuuuuaccauaagugugauaacaaaugcaucgaaaggguuagaaacgggacauaugaucacaaagaauucgaggaagaaucuaaaaucaaucgucaggagaucgagggaguaaaauuagacuccagugggaauguauauaaaauacugucaauuuacagcugcauugcaagcagucucguauuggcagcacucaucauggguuucauccucugggcgugcaguaauggaucauguagauguaccauuugcauuuag

SEQ ID NO: 40839 - RNA, 1698 nt, Artificial Sequence
  hemagglutinin__InfluenzaA__AGQ81203
augaagaaaacacugcuauuugcagcuauuuuccuuuaugugaaggcagaugaaaucugcaucggauacuuaagcaacaacucaacagacaaaguugacacaauaaucgagaacaaugucacgguaacuagcucaguggaacuagucgaaacagaacacacuggaucauucuguucaaucaaugggaaacaaccaauaagccuuggagauugcuccuucgcuggguggauauuggggaauccaaugugugaugaccuaauugguaagacuucauggucuuacaucguggagaaacccaacccagcaaacggaaucuguuacccaggaacauuggagaaugaagaagaacugagauugaaauucaguggaguccuggaauucaacaaauucgaagcauucacaucaaacggauggggugcuguaaauucaggagcaggagugacugcugcauguaaguuugggagcuccaauucuuucuuccgaaacaugguauggcugauacaccaaucaggaacauacccuguaauaaagaggaccuucaacaacaccaaaggaagagauguguugguuguuuggggaauucaccacccugccacacugaaagagcaucaggaccuauacaagaaggacagcuccuauguagcaguggguucagaaacuuacaacaggagauucauaccagaaaucagcacuaggcccaaaguuaauggacaggcuggacggaugacauuuuauuggacaauagucaaaccaggggagucaauaacauuugaaucuaauggugcauuccuggcuccuagauaugcuuuugagauugucucuguuggaaaugggaaacuauucaggagugaacugaauauugaaucaugcucuaccaagugucaaacagaaauaggaggaaucaauacaaacaagagcuuucacaguguucauagaaacacuaucggagacugucccaaauaugugaaugucaaaucuuuaaagcuugccacgggacucagaaaugucccagcaauagcaucaagaggcuuguuuggagcaauagccggguuuauagaagguggauggccuggacugaucaauggaugguacggguuucaacacaggaaugaagaaggaacagguauagcagcagacaaggagucaacucagaaggcgauagaccaaauaacguccaaaguaaauaauaucgucgacaggaugaauacaaauuucgagucugugcaacacgaauucagugaaauagaggagaggauaaaccaauugucgaaacauguagaugauucugugguugacauuuggucauauaaugcacaacuccucguucugcuugaaaaugaaaagacccuggaccuccacgauuccaaugucagaaaucuccaugagaagguuaggaggaugcuaaaggacaaugccaaagaugaggggaacggauguuucaccuuuuaccauaagugugauaacgaaugcaucgaaaggguuaggaacgggacauacgaucacaaagaauucgaggaagagucuaaaaucaaucgucaggagaucgagggagugaaauuagacuccagugggaauguauauaaaauacugucaauuuacagcugcauugcaagcagucucguauuggcagcacucaucauggguuucauccucugggcgugcaguaauggaucauguagauguaccauuugcauuuag

SEQ ID NO: 40840 - RNA, 1698 nt, Artificial Sequence
  hemagglutinin__InfluenzaA__AGQ81204
augaagaaaacacugcuauuugcagcuauuuuccuuuaugugaaggcagaugaaaucugcaucggauacuuaagcaacaacucaacagacaaaguugacacaauaaucgagaacaaugucacgguaacuagcucaguggaacuagucgaaacagaacacacuggaucauucuguucaaucaaugggaaacaaccaauaagccuuggagauugcuccuucgcuggguggauauuggggaaucccaugugugaugaccuaauugguaagacuucauggucuuacaucguggagaaacccaacccagcaaacggaaucuguuacccaggaacauuggagaaugaagaagaacugagauugaaauucaguggaguccuggaauucaacaaauucgaagcauucacaucaaacggauggggugcuguaaauucaggagcaggagugacugcugcauguaaguuugggagcuccaauucuuucuuccgaaacaugguauggcugauacaccaaucaggaacauacccuguaauaaagaggaccuucaacaacaccaaagggagagauguguugguuguuuggggaauucaccacccugccacacugaaagagcaucaggaccuauacaagaaggacagcuccuauguagcaguggguucagaaacuuacaacaggagauucauaccagaaaucagcacuaggcccaaaguuaauggacaggcuggacggaugacauuuuauuggacaauagucaaaccaggggagucaauaacauuugaaucuaauggugcauuccuggcuccuagauaugcuuuugagauugucucuguuggaaaugggaaacuauucaggagugaacugaauauugaaucaugcucuaccaagugucaaacagaaauaggaggaaucaauacaaacaagagcuuucacaguguucauagaaacacuaucggagacugucccaaauaugugaaugucaaaucuuuaaagcuugccacgggacucagaaaugucccagcaauagcaucaagaggcuuguuuggagcaauagccggguuuauagaagguggauggccuggacugaucaauggaugguacggguuucaacacaggaaugaagaaggaacagguauagcagcagacaaggagucaacucagaaggcgauagaccaaauaacguccaaaguaaauaauaucgucgacaggaugaauacaaauuucgggucugugcaacacgaauucagugaaauagaggagaggauaaaccaauugucgaaacauguagaugauucugugguugacauuuggucauauaaugcacaacuccucguucugcuugaaaaugaaaagacccuggaccuccacgauuccaaugucagaaaucuccaugagaagguuaggaggaugcuaaaggacaaugccaaagaugaggggaacggauguuucaccuuuuaccauaagugugauaacgaaugcaucgaaaggguuaggaacgggacauacgaucacaaagaauucgaggaagagucuaaaaucaaucgucaggagaucgagggagugaaauuagacuccagugggaauguauauaaaauacugucaauuuacagcugcauugcaagcagucucguauuggcagcacucaucauggguuucauccucugggcgugcaguaauggaucauguagauguaccauuugcauuuag

SEQ ID NO: 40841 - RNA, 1698 nt, Artificial Sequence
  hemagglutinin__InfluenzaA__AGQ81205
augaagaaaacacugcuauuugcagcuauuuuccuuuaugugaaggcagaugaaaucugcaucggauacuuaagcaacaacucaacagacaaaguugacacaauaaucgagaacaaugucacgguaacuagcucaguggaacuagucgaaacagaacacacuggaucauucuguucaaucaaugggaaacaaccaauaagccuuggagauugcuccuucgcuggguggauauuggggaauccaaugugugaugaccuaauugguaagacuucauggucuuacaucguggagaaacccaacccagcaaacggaaucuguuacccaggaacauuggagaaugaagaagaacugagauugaaauucaguggaguccuggaauucaacaaauucgaagcauucacaucaaacggauggggugcuguaaauucaggagcaggagugacugcuacauguaaauuugggagcuccaauucuuucuuccgaaacaugguauggcugauacaccaaucaggaacauacccuguaauaaagaggaccuucaacaacaccaaaggaagagauguguugguuguuuggggaauucaccacccugccacacugaaagagcaucaggaccuauacaagaaggacagcuccuauguagcaguggguucagaaacuuacaacaggagauucauaccagaaaucagcacuaggcccaaaguuaauggacaggcuggacggaugacauuuuauuggacaauagucaaaccaggggagucaauaacauuugaaucuaauggugcauuccuggcuccuagauaugcuuuugagauugucucuguuggaaaugggaaacuauucaggagugaacugaauauugaaucaugcucuaccaagugucaaacagaaauaggaggaaucaauacaaacaagagcuuucacaguguucauagaaacacuaucggagacugucccaaauaugugaaugucaaaucuuuaaagcuugccacgggacucagaaaugucccagcaauagcaucaagaggcuuguuuggagcaauagccggguuuauagaagguggauggccuggacugaucaauggaugguacggguuucaacacaggaaugaagaaggaacagguauagcagcagacaaggagucaacucagaaggcgauagaccaaauaacguccaaaguaaauaauaucgucgacaggaugaauacaaauuucgagucugugcaauacgaauucagugaaauagaggagaggauaaaccaauugucgaaacauguagaugauucugugguugacauuuggucauauaaugcacaacuccucguucugcuugaaaaugaaaagacccuggaccuccacgauuccaaugucagaaaucuccaugagaagguuaggaggaugcuaaaggacaaugccaaagaugaggggaacggauguuucaccuuuuaccauaagugugauaacgaaugcaucgaaaggguuaggaacgggacauacgaucacaaagaauucgaggaagagucuaaaaucaaucgucaggagaucgagggagugaaauuagacuccagugggaauguauauaaaauacugucaauuuacagcugcauugcaagcagucucguauuggcagcacucaucauggguuucauccucugggcgugcaguaauggaucauguagauguaccauuugcauuuag

SEQ ID NO: 40842 - RNA, 1698 nt, Artificial Sequence
  hemagglutinin__InfluenzaA__AGQ81206
augaagaaaacacugcuauuugcagcuauuuuccuuuaugcaaaggcagaugaaaucugcaucggcuauuuaagcaacaauucaacagacaaagucgacacaauaaucgagaacaaugucacgguaacuagcucaguggaacuagucgagacagaacacacuggaucauucuguucaaucaaugggaaacaaccaauaagccuuggagauugcucuuucgcuggguggauauuggggaaucccaugugugaugaccuaauugguaagacuucauggucuuacaucguggagaaacccaacccagcaaacggaaucuguuacccaggaacauuggagaaugaagaagaacugagaucgaaauucaguggaguccuggaauucagcaaauucgaagcauucacaucaaacggauggggugcuguaaauucaggagcaggagugacugcugcauguaaguuugggagcuccaauuccuucuuccgaaacaugguauggcugauacaccaaucaggaacauauccuguaauaaagaggaccuucaacaacaccaaaggaagagauguguugguuguuuggggaauucaccacccugccacacugaaagagcaucaggaccuauacaagaaggacagcuccuauguagcaguggguucagaaaccuacaacaggagauucauaccagaaaucagcacuaggcccaaaguuaauggacaggcuggacggaugacauuuuauuggacaauagucaaaccagaggagucaauaacauuugaaucuaauggugcauuccuggcuccuagauaugcuuuugagauugucucuguuggaaaugggaaacuauucaggagugaacugaauauugaaucaugcucuaccaaaugucaaacggaaauaggaggaauuaauacaaacaaaagcuuucacaguguucauagaaacacuaucggagacugucccaaauaugugaaugucaaaucguuaaagcuugccacgggacucagaaaugucccagcaauagcaucaagaggcuuguucggagcaauagccggguuuauagaagguggauggccuggacugaucaauggaugguacggguuucaacacaggaaugaagaaggaacagguauagcagcagacaaggagucaacucagaaggcaauagaccagauaacguccaaaguaaauaauaucgucgacaggaugaauacaaauuucgagucugugcaacacgaauucagugaaauagaggagaggauaaaccaauugucgaaacauguagaugauucugugguugacaucuggucauauaaugcacaacuccucguuuugcuugaaaaugagaagacccuggaccuccaugauuccaaugucagaaaucuccaugagaagguuaggagaaugcuaaaggacaaugccaaagaugaggggaacggguguuucaccuuuuaccauaagugugauaaugaaugcaucgaaaggguuaggaacgggacauacgaucacaaagaauucgaggaagaaucuaaaaucaaucgucaggagaucgagggagugaaauuagacuccagugggaaugucuauaaaauacugucaauuuacagcugcauugcaagcagucucauauuggcagcacucaucauggguuucauccucugggcgugcaguaauggaucauguagauguaccauuugcauuuag

SEQ ID NO: 40843 - RNA, 1698 nt, Artificial Sequence
  hemagglutinin__InfluenzaA__AGQ81209
augaagaaaacacugcuauuugcagcuauuuuccuuuauguaaaggcagaugaaaucuguaucggcuauuuaagcaacaacucaacagacaaaguugacacaauaauugagaacaaugucacuguaacuagcucaguggaacuaguugaaacagaacacacugggucauucuguucaaucaaugggaaacaaccaauaagccuuggagauugcuccuuugcuggguggauauugggaaaucccaugugugaugaccuaauugguaagacuucaugguccuacauuguggagaagcccaacccagcaaacggaaucuguuacccaggaacauuggagaaugaagaagaacugagauugaaauucaguggaauccuggaauucagcaaauucgaagcauucacaucaaacggauggggugcugugaauucaggagcaggagugaccgcugcaugcaaguuugggagcuccaauucauucuuccgaaacaugguauggcugauacaccaaucaggaacauacccuguaauaaagagaaccuucaacaacaccaaaggaagagauguguugauuguuuggggaauucaccacccugccacacugaaagagcaccaggaccuauacaagaaggacagcuccuauguagcaguggguucagaaaccuacaacaggagauucauaccagaaaucagcacuaggcccaaaguuaauggacaggcuggacggaugacauuuuauuggacaauagucaaaccaggggagucaauaacauuugagucuaauggugcauuccuggcuccuagauaugcuuuugagauugucuccguugggaauggaaaacuauucaggagugaacugaauauugaaucaugcucuaccaaaugucaaacagaaauaggaggaauuaauacaaacaaaagcuuucacaguguucacagaaacacuaucggagacugucccaaauaugugaaugucaaaucucuaaagcuugccacgggacucagaaaugucccagcaauagcaucaagaggcuuguuuggagcaauagccggauuuauagaagguggauggccuggacugaucaauggaugguacggguuucaacauaggaaugaagaaggaacaggcauagcagcagacaaggagucaacucagaaggcaauagaccagauaacguccaaaguaaauaauaucgucgacagaaugaauacaaauuucgagucugugcaacacgaauucagugaaauagaggagaggauaaaccaguugucgaaacauguagaugauucuguggucgacaucuggucauauaaugcacaacuucucguuuugcuugaaaaugagaagacccuggaccuccacgauuccaaugucagaaaucuccaugagaagguuagaaggaugcuaaaagacaaugccaaagacgaggggaacggauguuucaccuuuuaccauaagugugauaaugaaugcaucgaaaggguuagaaacggaacauaugaucacaaggaauucgaagaagaaucuaaaaucaaucgucaggagaucgagggagugaaauuagacucuagugggaauguguauagaauacugucaauuuacagcugcauugcaagcagucucguauuggcagcgcucaucauggguuucauccucugggcgugcaguaauggaucauguagauguaccauuugcauuuag

SEQ ID NO: 40844 - RNA, 1698 nt, Artificial Sequence
  hemagglutinin__InfluenzaA__AGQ81211
augaagaaaacacugcuauuugcagcuauuuuccuuuauguaaaggcagaugaaaucuguaucggcuauuuaagcaacaacucaacagacaaaguugacacaauaauugagaacaaugucacuguaacuagcucaguggaacuagucgaaacagaacacacugggucauucuguucaaucaaugggaaacaaccaauaagccuuggagauugcuccuuugcuggguggauauugggaaaucccaugugugaugaccuaauugguaagacuucaugguccuacauuguggagaagcccaacccagcaaacggaaucuguuacccaggaacauuggagaaugaagaagaacugagauugaaauucaguggaguccuggaauucagcaaauucgaagcauucacaucaaacggauggggugcugugaauucaggagcaggagugaccgcugcaugcaaguuugggagcuccaauucauucuuccgaaacaugguauggcugauacaccaaucaggaacauacccuguaauaaagagaaccuucaacaacaccaaaggaagagauguguugauuguuuggggaauucaccacccugccacacugaaagagcaccaggaccuauacaagaaggacagcuccuauguagcaguggguucagaaaccuacaacaggagauucauaccagaaaucagcacuaggcccaaaguuaauggacaggcuggacggaugacauuuuauuggacaauagucaaaccaggggagucaauaacauuugagucuaauggugcauuccuggcuccuagauaugcuuuugagauugucuccguugggaauggaaaacuauucaggagugaacugaauauugaaucaugcucuaccaaaugucaaacagaaauaggaggaauuaauacaaacaaaagcuuucacaguguucacagaaacacuaucggagacugucccaaauaugugaaugucaaaucucuaaagcuugccacgggacucagaaaugucccagcaauagcaucaagaggcuuguuuggagcaauagccggauuuauagaagguggauggccuggacugaucaauggaugguacggguuucaacauaggaaugaagaaggaacaggcauagcagcagacaaggagucaacucagaaggcaauagaccagauaacguccaaaguaaauaauaucgucgacagaaugaauacaaauuucgagucugugcaacacgaauucagugaaauagaggagaggauaaaccaguugucgaaacauguagaugauucuguggucgacaucuggucauauaaugcacaacuucucguuuugcuugaaaaugagaagacccuggaccuccacgauuucaaugucagaaaucuccaugagaagguuagaaggaugcuaaaagacaaugccaaagacgaggggaacggauguuucaccuuuuaccauaagugugauaaugaaugcaucgaaaggguuagaaacggaacauaugaucacaaggaauucgaagaagaaucuaaaaucaaucgucaggagaucgagggagugaaauuagacucuagugggaauguguauagaauacugucaauuuacagcugcauugcaagcagucucguauuggcagcgcucaucauggguuucauccucugggcgugcaguaauggaucauguagauguaccauuugcauuuag

SEQ ID NO: 40845 - RNA, 1698 nt, Artificial Sequence
  hemagglutinin__InfluenzaA__AGQ81213
augaagaaaacacugcuauuugcagcuauuuuccuuuauguaagggcagaugaaaucuguaucggcuauuuaaguaacaacucaacagacaaaguugacacaauaauugagaacaaugucaccguaacuagcucaguggaacuagucgaaacagaacacacugggucauucuguucaauuaaugggaaacaaccaauaagccuuggagauugcuccuuugcuggguggauauugggaaaucccaugugugauggccuaauugguaagacuucauggucuuacauuguggaaaagcccaacccagcaaacggaaucuguuacccaggaacauuggagaaugaagaagaacugagauugaaauucaguagaguccuggaauucagcaaauucgaagcauucacaucaaauggauggggugcugugaauucaggagcaggagugacugcugcaugcaaguuugggagcuccaauuccuucuuccgaaacaugguauggcugauacaccaaucaggaacauacccuguaauaaagaggaccuucaacaacaccaaaggaagagauguguugguuguuuggggaauucaucacccugccacacugaaagagcaccaggaucuauacaagaaggacagcuccuauguagcaguggguucagaaaccuacaacaggagauucauaccagaaaucagcacuaggcccacaguuaaugggcaggcuggacggaugaccuuuuauuggacaauagucaaaccaggagaaucaauaacauuugagucuaauggugcauuccuagcucccagauaugcuuuugagauugucuccguugggaauggaaaacuauucaggagugaacugaauauugaaucaugcucuaccaaaugucaaacggaaauaggaggaauuaauacaaacaaaagcuuucacaguguucacagaaacacuaucggagacugucccaaauaugugaaugucaaaucucuaaagcuugccacgggacucagaaaugucccagcaauagcaucaagaggcuuguuuggagcaauagccggguuuauagaagguggauggcccggacugaucaauggaugguacggguuucaacauagaaaugaagaaggaacaggcauagcagcagacaaagagucaacucagaaggcaauagaccagauaacauccaaaguaaauaauauagucgacagaaugaauacaaauuucgagucugugcaacacgaauucagugaaauagaggagaggauaaaccaguugucgaaacauguagaugauucuguggucgacaucuggucauauaaugcacaacuucucguuuugcuugaaaaugagaaaacccuggaccuccacgauuccaaugucagaaaucuccaugagaagguuagaagaaugcuaaaggacaaugccaaagacgaggggaacggauguuucaccuuuuaccauaagugugauaaugaaugcaucgaaaggguuagaaacgggacauaugaucacaaggaauucgaagaagaaucuaaaaucaaucgucaggagaucgagggagugaaauuagacucuagugggaauguguauaaaauacugucaauuuacagcugcauugcaagcagucucguauuggcagcgcucaucauggguuucauccucugggcgugcaguaauggaucauguagauguaccauuugcauuuag

SEQ ID NO: 40846 - RNA, 1698 nt, Artificial Sequence
  hemagglutinin__InfluenzaA__AGQ81214
augaagaaaacacugcuauuugcagcuauuuuccuuuauguaaaggcagaugaaaucuguaucggcuacuuaagcaacaacucaacagacaaaguugacacaauaauugaaaacaaugucacuguaacuagcucaguggaacuagucgaaacagaacacacugggucauucuguucaaucaaugggaaacaaccaauaagccuuggagauugcuccuuugcuggguggauauugggaaaucccaugugugaugaccuaauugguaagacuucaugguccuacauuguggagaagcccaacccagcaaacggaaucuguuacccaggaacauuggagaaugaagaagaacugagauugaaauucaguggaguccuggaauucagcaaauucgaagcauucacaucaaacggauggggugcuguaaauucaggagcaggagugacugcugcaugcaaguuugggagcuccaauuccuucuuccgaaacaugguauggcugauacaccaaucaggaacauacccuguaauaaagaggaccuucaacaacaccaagggaagagauguguugauuguuuggggaauucaccacccugcaacacugaaagagcaccaggaucuauacaagaaggacagcuccuauguagcaguggguucagaaaccuacaacaggagauucauaccagaaaucagcacuaggcccaaaguuaauggacaggcuggacggaugaccuuuuauuggacaauagucaaaccaggagagucaauaacauuugagucuaauggugcauuccuagcuccuagauaugcuuuugagauugucuccguugggaaugggaaacuauucaggagugaacugaauauugaaucaugcucuaccaaaugucaaacagaaauaggaggaauuaauacaaacaaaagcuuucacaguguucacagaaacacuaucggagacugucccaaauaugugaaugucaaaucucuaaagcuugccacgggacucagaaaugucccagcaauaacaucaagaggcuuguuuggagcaauagccggguuuauagaagguggauggccuggacugaucaauggaugguacggguuucaacauaggaaugaagaaggaacaggcauagcggcagacaaggagucaacucagaaggcaauagaccagauaacguccaaaguaaauaauaucgucgacagaaugaauacaaauuucgagucugugcaacacgaauucagugaaauagaggggaggauaaaccaguugucgaaacauguagaugauucuguggucgacaucuggucauauaaugcacagcuucucguuuugcuugaaaaugagaagacccuggaucuccacgauuccaaugucagaaaucuccaugagaagguuagaaggaugcuaaaggacaaugccaaagacgaggggaacggauguuucaccuuuuaccauaagugugauaaugaaugcauugaaaggguuagaaacggaacauaugaucacaaggaauucgaagaagaaucuaaaauaaaucgucaggagaucgagggagugaaauuagacucuagugggaauguguauaaaauacugucaauuuacagcugcauugcaagcagucucguauuggcagcacucaucauggguuucauccucugggcgugcaguaacggaucauguagauguaccauuugcauuuag

SEQ ID NO: 40847 - RNA, 1698 nt, Artificial Sequence
  hemagglutinin__InfluenzaA__AGQ81215
augaagaaaacacugcuauuugcagcuauuuuccuuuauguaaaagcagaugaaaucuguaucggcuauuuaagcaacaacucaacagacaagguugacacaauaaucgagaacaaugucacaguaacuagcucaguggaacuaguugaaacagaacacacuggaucauucuguucaaucaaugggaaacaaccaauaagccuuggagauugcuccuuugcgggguggauauugggaaaucccaugugugauggccuaauugguaagacuucaugguccuacauuguggagaagcccaacccagcaaacggaaucuguuacccaggaacauuggagaaugaagaagaacugagauugaaauucaguggaauacuggaauucagcaaauucgaagcauucacaucaaacggauggggugcugugaauucaggagcaggagugacugcugcaugcaaguuugggagcuccaauuccuucuuccgacacaugguauggcugauacaccaaucgggaacauacccuguaauaaagaggaccuucaacaacaccaaaggaagagauguguugguuguuuggggaauucaccacccugccacacugaaagagcaacaggaucuauacaagaaggacagcuccuauguagcaguggguucagaaaccuacaacaggagauucauaccagaaaucagcacuaggcccaaaguuaauggacaagcuggacggaugacauuuuauuggacaauagucaaaccaggagagucaauaacauuugagucuaauggugcauuccuagcuccuagauaugcuuuugagauuguuuccguuggaaauggaaaacuauucaggagugaacugaauauugaaucaugcucuaccaaaugucaaacagaaauaggagggauuaauacaaacaaaagcuuucacaguguucacagaaacacuaucggagacugucccaaauaugugaaugucaaaucucuaaagcuugccacaggacucagaaaugucccagcaauagcaucaagaggcuuguuuggggcaauagccggauuuauagaagguggauggccuggacugaucaauggaugguacggguuucaacauagaaaugaagaaggaacaggcauagcagcagacaaggagucaacucagaaggcaauagaccaaauaacguccaaaguaaauaauaucgucgacagaaugaauacaaauuucgagucugugcaacacgaauucagugaaauagaggagaggauaaaccaguugucgaaacauguagaugauucuguggucgacaucuggucauauaaugcacagcuccucguuuugcuugaaaaugagaagacccuggaccuccacgauuccaaugucagaaaucuccaugagaagguuagaagaaugcuaaaggacaaugccaaagacgaggggaacggauguuucaccuuuuaccauaagugugauaaugaaugcaucgaaaggguuagaaacggaacauaugaucacaaagaauuugaagaagaaucuaaaaucaaucgucaggagaucgagggagugaaauuagacuccagugggaauguguauaaaauacugucaauuuacagcugcauugcaagcagucucguauuggcggcacucauuauggguuucauccucugggcaugcaguaauggaucauguagauguaccauuugcauuuag

SEQ ID NO: 40848 - RNA, 1698 nt, Artificial Sequence
  hemagglutinin__InfluenzaA__AGQ81216
augaagaaaacacugcuauuugcagcuaucuuccuuuauguaaaggcagaugagaucugcaucggcuauuuaagcaacaacucaacagacaaaguugacacaauaaucgagaacaaugucacgguaacuagcucaguggaacuagucgaaacagagcacacuggaucauucuguucaaucaaugggaaacaaccaauaagccuuggagauugcuccuuugcuggguggauauuggggaaucccaugugugaugaucuaauugguaagacuucaugguccuacauuguagagaagcccaacccagcaaacggaaucuguuacccaggaacauuggagaaugaagaagaacugagauugaaauucaguggaguccuggaauucagcaaauuugaagcauucacaucaaauggauggggugcuguaaauucaggagcaggagugacugcugcaugcaaguuugggagcuccaauuccuucuuccgaaacaugguauggcugauacaccaaucaggaacauacccuguaacaaaaaggaccuucaacaacaccaaaggaagagauguguugguugucuggggaauucaccacccugccacacugaaagagcaucaggaucuauacaagaaggacagcuccuauguagcaguggguucagaaaccuacaacaggagauucacaccagaaaucagcacuaggcccaaaguuaauggacaggcuggacggaugacauuuuauuggacaauagucaaaccaggagagucaauaacauuugagucuaauggugcauucuuggcuccuagauaugcuuuugaaauugucuccguuggaaauggaaaacuauucaggagugaacugaauauugaaucaugcucuaccaaaugucaaacagaaauaggaggaauuaauacaaacaaaagcuuucacaguguucauaggaacacuaucggagauugccccaaauauguaaaugucaagucucuaaagcuugccacgggacucagaaaugucccagcaauagcaucaaaaggcuuauuuggagcaauagccggauuuauagaagguggauggccugggcugaucaauggaugguacggauuucaacacaggaaugaagaagggacagguauagcagcagacaaagagucaacucagaaggcaauagaccaaauaacguccaaaguaaacaauaucgucgacaggaugaauacaaauuucgagucuguucgacacgaguucagugaaauagaggagaggauaaaucaauugucgaaacauguagaugauucuguaguugacaucuggucauauaaugcacaacuccucguuuugcuugaaaaugagaagacccuggaccuucacgauuccaaugucagaaaucuccaugagaggguuagaaggaugcuaaaagacaaugccaaagaugaggggaacggauguuucaccuuuuaccacaagugugacaacgaaugcauugaaagggucagaaacgggacauaugaucacaaagaauucgaggaagaauccaaaaucaaucgucaggagaucgagggagugaaauuagacuccagugggaauguguauaaaauacugucaauuuacagcugcauugcaagcagucucguauuggcagcacucaucauggguuucauccucugggcgugcgguaauggaucauguagauguaccauuugcauuuag

SEQ ID NO: 40849 - RNA, 1698 nt, Artificial Sequence
  hemagglutinin__InfluenzaA__AGQ81217
augaagaaaacacugcuauuugcagcuauuuuccuuuaugcaaaggcagaugaaaucugcaucggcuauuuaagcaacaauucaacagacaaagucgacacaauaaucgagaacaaugucacgguaacuagcucaguggaacuagucgagacagaacacacuggaucauucuguucaaucaaugggaaacaaccaauaagccuuggagauugcucuuucgcuggguggauauuggggaaucccaugugugaugaccuaauugguaagacuucauggucuuacaucguggagaaacccaacccagcaaacggaaucuguuacccaggaacauuggagaaugaagaagaacugagauugaaauucaguggaguccuggaauucagcagauucgaagcauucacaucaaacggauggggugcuguaaauucaggagcaggagugacugcugcauguaaguuugggagcuccaauuccuucuuccgaaacaugguauggcugauacaccaaucaggaacauauccuguaauaaagaggaccuucaacaacaccaaaggaagagauguguugguuguuuggggaauucaccacccugccacacugaaagagcaucaggaccuauacaagaaggacagcuccuauguagcaguggguucagaaaccuacaacaggagauucauaccagaaaucagcacuaggcccaaaguuaauggacaggcuggacggaugacauuuuauuggacaauagucaaaccagaggagucaauaacauuugaaucuaauggugcauuccuggcuccuagauaugcuuuugagauugucucuguuggaaaugggaaacuauucaggagugaacugaauauugaaucaugcucuaccaaaugucaaacggaaauaggaggaauuaauacaaacaaaagcuuucacaguguucauagaaacacuaucggagacugucccaaauaugugaaugucaaaucguuaaagcuugccacgggacucagaaaugucccagcaauagcaucaagaggcuuguucggagcaauagccggguuuauagaagguggauggccuggacugaucaauggaugguacggguuucaacacaggaaugaagaaggaacagguauagcagcagacaaggagucaacucagaaggcaauagaccagauaacguccaaaguaaauaauaucgucgacaggaugaauacaaauuucgagucugugcaacacgaauucagugaaauagaggagaggauaaaccaauugucgaaacauguagaugauucugugguugacaucuggucauauaaugcacaacuccucguuuugcuugaaaaugagaagacccuggaccuccaugauuccaaugucagaaaucuccaugagaagguuaggagaaugcuaaaggacaaugccaaagaugaggggaacggauguuucaccuuuuaccauaagugugauaaugaaugcaucgaaaggguuaggaacgggacauacgaucacaaagaauucgaggaagaaucuaaaaucaaucgucaggagaucgagggagugaaauuagacuccagugggaaugucuauaaaauacugucaauuuacagcugcauugcaagcagucucauauuggcagcacucaucauggguuucauccucugggcgugcaguaauggaucauguagauguaccauuugcauuuag

SEQ ID NO: 40850 - RNA, 1704 nt, Artificial Sequence
  hemagglutinin__InfluenzaA__AGQ88499
auggagaaaauagugcuucuuuuugcaacaaucagccuuguuaaaagcgaucauauuugcauugguuaucaugcaaauaacucgacagagcagguugacacaauaauggaaaagaacguuacuguuacacaugcccaagacauacuggaaaagacacacaacgggaagcucugcgaucuaaauggagugaagccucugauuuuaaaagauuguaguguagcaggauggcuccucggaaacccaaugugugacgaauucaucaaugugccagaauggucuuacauaguagagaaggccaauccagccaaugaccucuguuacccagggaauuucaacgauuaugaggaauugaaacaccuauugagcagaauaaaccauuuugagaaaauacaaaucauccccaaagauucuuggacagaucaugaagccucauugggggugagugcagcauguccauaccagggaaauuccuccuucuucagaaaugugguauggcuuaucaaaaaggacaaugcauacccaacaauaaagaaaggcuacaauaauacuaaccaagaagaucucuugguacugugggggauucaccauccuaauaaugaggcagagcagacaaggcucuaucaaaacccaaccaccuauauuuccauugggacaucaacacuaaaccagagauugguaccaaaaauagccacuagauccaaaauaaacggacaaaguggcagaauagauuucuucuggacaauuuuaaaaccgaaugaugcaauccacuucgagaguaauggaaauuucauugcuccagaauaugcauacaaaauugucaagaaaggagacucaacaauuaugaaaagugaaguggaauaugguaacugcaacaccaggugucagacuccgauaggggcgauaaacucuaguaugccguuccacaacauacacccucucaccaucggagaaugucccaaauaugugaaaucaaacaaacuaguccuugcuacugggcucagaaauaguccucaaagagagagaagaagaaaaagaggauuguuuggagcuauagcagguuuuauagagggaggauggcagggaaugguagaugguugguauggguaccaccacagcaaugagcaggggaguggguacgcugcagacaaggaaucaacucaaaaggcaauagacggagucaccaauaaggucaacucgaucauugacaaaaugaacacucaguuugaggccguaggaagggaauuuaauaacuuagagaggagaauagagaauuugaacaagaagauggaagacggauuccuagaugucuggacuuauaaugcugaacuucugguucucauggaaaaugagagaacucuagacuaccaugacucaaaugucaggaaccuuuacgacaaggucagacuacagcuuaaggauaacgcaaaagagcuggguaacgguuguuucgaguucuaucacaaauguaauaaugaauguauggaaaguguaagaaacggaacguaugacuacccgcaguauucagaagaagcaagauuaaaaagagaggaaauaaguggaguaaaauuggaaucaauaggaaucuaccaaauacugucaauuuauucaacaguggcgaguucccuaguacuggcaaucaugauggcuggucuaucuuuauggauguguuccaacgggucguuacagugcagaauuugcauuuaa

SEQ ID NO: 40851 - RNA, 1683 nt, Artificial Sequence; identical to SEQ ID NO: 40746
  hemagglutinin__InfluenzaA__AGR33888

SEQ ID NO: 40852 - RNA, 1683 nt, Artificial Sequence; identical to SEQ ID NO: 40746
  hemagglutinin__InfluenzaA__AGR33889

SEQ ID NO: 40853 - RNA, 1683 nt, Artificial Sequence
  hemagglutinin__InfluenzaA__AGR33890
augaacacucaaauccuaguauucgcucugauugcgaucacuccaacaaauucagacaaaaucugccucggacaucaugcugugucaaacggaaccaaaguaaacacauuaacugaaagaggaguggaagucgucaaugcaacugaaacaguggaacgaacaagcauccccaggaucugcucaaaagggaaaagaacaguugaccucggucaauguggacuccuagggacaaucacugggccaccucaaugugaccaauuccuagaauuuucagccgauuuaauuauugagaggcgagaaggaagugaugucuguuauccugggaaauucgugaaugaagaagcucugaggcaaauucucagggaaucaggcggaaucgacaaggaagcaaugggauucacauacagcggaauaagaacuaauggagcaaccagugcauguaggagaucaggaucuucauucuaugcagaaaugaaauggcuccuaucaaacacagauaaugcugcuuucccgccgaugacuaagucauauaaaaauacaagaaaggccccagcucuaauaauaugggggauccaucauuccguaucaacugcagagcaaaccaagcuauaugggaguggaaacaaacuggugacaguuaggaguucuaauuaucaacaaucuuuugugccgaguccaggagcgggaccacaaguuaauggucaaucuggaaggauugacuuucauuggcuaaugcuaaaucccaaugacacagucaccuucagcuucaauggggcuuucauagcuccagaccgugcaagcuuccugagagggaaaucuaugggaauccagaguggaguacagguugaugccaauugugaaggggacugcuaucauaguggagggacaauaauaaguaauuugccauuucagaacauagacagcagaguaguaggaaaauguccgagauauguuaagcaaaagagucugcugcuagcaacagggaugaagaauguuccugagauuccaaagggaagaggccuauuuggugcuauagcggguuucauugaaaauggaugggaaggccuaauugaugggugguaugguuucagacaccagaaugcacagggagagggaacugcugcagauuacaaaagcacucaaucggcaauuaaucaaaugacaggaaaauuaaaccggcuuauagaaaaaaccaaccaacaauuugaguugauagacaaugaauucacugagguagagaagcaaauugguaaugugauaaauuggaccagagacucuauaacagaaguguggucauacaaugcugaacucuugguagcaauggagaaccagcauacaauugaucuggcugauucagaaaugaacaaacuguacgaacgagugaaaagacagcugagagagaaugcugaagaagauggcacugguugcuuugaaauauuucacaaaugugaugaugacuguauggccaguauuagaaauaacaccuaugaucacagcaaauacagggaggaagcaaugcaaaauagaauacagauugacccagucaaacuaagcagcggcuacaaagaugugauacuuugguuuagcuucggggcaucauguuucauacuucuagccauugcaaugggccuugucuucauaugugugaaaaauggaaacaugcggugcacuauuuguauauaa

SEQ ID NO: 40854 - RNA, 1683 nt, Artificial Sequence
  hemagglutinin__InfluenzaA__AGR33892
augaacacucaaauccuaguauucgcucugauugcgaucauuccaacaaaugcagacaaaaucugccucggacaucaugcugugucaaacggaaccaaaguaaacacauuaacugaaagaggaguggaagucgucaaugcaacugaaacaguggaacgaacaagcauccccaggaucugcucaaaagggaaaagaacaguugaccucggucaauguggacuccuagggacaaucacugggccaccucaaugugaccaauuccuagaauuuucagccgauuuaauuauugagaggcgagaaggaagugaugucuguuauccugggaaauucgugaaugaagaagcucugaggcaaauucucagggaaucaggcggaaucaacaaggaagcaaugggauucacauacagcggaauaagaacuaauggagcaaccagugcauguaggagaucaggaucuucauucuaugcagaaaugaaauggcuccuaucaaacacagauaaugcugcuuucccgccgaugacuaagucauauaaaaauacaagaaaggccccagcucuaauaauaugggggauccaucauuccggaucaacugcagagcaaaccaagcuauaugggaguggaaacaaaauggugacaguuaggaguucuaauuaucaacaaucuuuugugccgaguccaggagcgggaccacaaguuaauggucaaucuggaaggauugacuuucauuggcuaaugcuaaaucccaaugacacagucacuuuuagcuucaauggggcuuucauagcuccagaccgugcaagcuuccugagagggaaaucuaugggaauccagaguggaguacagguugaugccaauugugaaggggacugcuaucauaguggagggacaauaauaaguaauuugccauuucagaacauagacagcagaguaguaggaaaauguccgagauauguuaagcaaaagagucugcugcuagcaacagggaugaagaauguuccugagauuccaaagggaagaggccuauuuggugcuauagcggguuucauugaaaauggaugggaaggccuaauugaugggugguaugguuucagacaccagaaugcacagggagagggaacugcugcagauuacaaaagcacucaaucggcaauuaaucagaugacaggaaaauuaaaccggcuuauagaaaaaaccaaccaacaauuugaguugauagacaaugaauucacugagguagagaagcaaauugguaaugugauaaauuggaccagagacucuauaacagaaguguggucauacaaugcugaacucuugguagcaauggagaaccagcauacaauugaucuggcugauucagaaaugaacaaacuguacgaacgagugaaaagacagcugagagagaaugcugaagaagauggcacugguugcuuugaaauauuucacaaaugugaugaugacuguauggccaguauuagaaauaacaccuaugaucacagcaaauacagggaggaagcaaugcaaaauagaauacagauugacccagucaaacuaagcagcggcuacaaagaugugauacuuugguuuagcuucggggcaucauguuucauacuucuagccauugcaaugggccuugucuucauauguguagaaaauggaaacaugcggugcacuauuuguauauaa

SEQ ID NO: 40855 - RNA, 1683 nt, Artificial Sequence; identical to SEQ ID NO: 40736
  hemagglutinin__InfluenzaA__AGR33895

SEQ ID NO: 40856 - RNA, 1683 nt, Artificial Sequence
  hemagglutinin__InfluenzaA__AGR33897
auggagacaguaucacuaauaacuauacuacuaguagcaacaguaagcaaugcagauaaaaucugcaucggcuaucaaucaacaaacuccacagaaacuguggacacacuaacagaaaacaaugucccugugacacaugccaaagaacugcuccacacagagcauaaugggaugcugugugcaacaagcuugggacaaccucuuauuuuagacaccugcaccauugaagggcuaaucuauggcaauccuucuugugaucuauugcuggaaggaagagaaugguccuauaucgucgagagaccgucagcuguuaacggauuguguuaccccgggaauguagagaaucuagaagagcuaaggucacuuuuuaguucugcuaggucuuaucaaagaauccagauuuucccagacacaaucuggaaugugucuuacgaugggacaagcaaagcaugcucagguucauucuacagaagcaugagaugguugacucaaaagaacagcgauuacccuauucaagacgcccaauacacaaauaaucaagggaagaacauucuuuucauguggggcauaaaucacccacccaccgauacuacgcagagagaucuguacacgagaaccgacacaacaacgaguguggcaacagaagaaauaaauaggaucuucaaaccauugauuggaccaaggccucuugucaacgguuugaugggaagaauugauuauuauuggucgguauugaaaccgggucaaacacugcgaauaaaaucugaugggaaucuaauagcuccaugguauggacacauucuuucaggagagagccacggaagaauucugaagacugauuuaaaaaaggguagcugcacagugcaaugucagacagagaaagguggcuuaaacacaacauugccauuccaaaauguaaguaaguaugcauuuggaaacugcucaaaguacauuggcauaaagagucucaaacuugcaguuggucugaggaaugugccuucuagaucuaguagaggauuauucggggccauagcaggguuuauagagggagguuggucaggacuaguugcugguugguauggguuccagcauucaaaugaccaagggguugguauggcagcagauagagacucaacccaaaaggcaauugauaaaauaacauccaaagugaauaauauagucgacaaaaugaacaagcaguaugaaaucauugaucaugaauucagugagguagaaacuagacuuaacaugaucaauaauaagauugaugaucaaauccaggauauaugggcauauaaugcagaauugcuaguucugcuugaaaaccagaaaacacucgaugagcaugacgcaaauguaaacaaucuauauaauaaaguaaagagggcguuggguuccaaugcgguggaagaugggaaaggauguuucgagcuauaccacaaaugugaugaccaaugcauggagacaauucggaacgggaccuacaacagaaggaaguaucaagaggagucaaaauuagaaagacagaaaauagagggggucaagcuggaaucugaaggaacuuacaaaauccucaccauuuauucgacugucgccucaucucuugugauugcaaugggguuugcugccuucuuguucugggccauguccaaugggucuugcagaugcaacauuuguauauaa

SEQ ID NO: 40857 - RNA, 1683 nt, Artificial Sequence
  hemagglutinin__InfluenzaA__AGR33899
auggagacaguaucacuaauaacuauacuacuaguagcaacaguaagcaaugcagauaaaaucugcaucggcuaucaaucaacaaacuccacagaaacuguggacacacuaacagaaaacaaugucccugugacacaugccaaagaacugcuccacacagagcauaaugggaugcugugugcaacaagcuugggacaaccucuuauuuuagacaccugcaccauugaagggcuaaucuauggcaauccuucuugugaucuauugcuggaagggagagaaugguccuauaucgucgagagaccaucagcuguuaacggauuguguuaccccgggaauguagagaaucuagaagagcuaaggucacuuuuuaguucugcuaggucuuaucaaagaauccagauuuucccagacacaaucuggaaugugucuuacaaugggacaagcaaagcaugcucagguucauucuacagaagcaugagaugguugacucaaaagaacagcaauuacccuauucaagacgcccaauacacaaauaaucaagggaagaacauucuuuucauguggggcauaaaucacccacccaccgacacuacgcagagagaucuguacacgagaaccgacacaacaacgaguguggcaacagaagaaauaaauaggaucuucaaaccauugauuggaccaaggccucuugucaacgguuugaugggaagaauugauuauuauuggucgguauugaaaccaggucaaacacugcgaauaaaaucugaugggaaucuaauagcuccaugguauggacacauucuuucaggagagagccacggaagaauucugaagacugauuuaaaaaaggguagcugcacagugcaaugucagacagagaaagguggcuuaaacacaacauugccauuccaaaauguaaguaaguaugcauuuggaaacugcucaaaguacauuggcauaaagagucucaaacuugcaguuggucugaggaaugugccuucuagaucuaguagaggauuauucggggccauagcaggguuuauagagggagguuggucaggacuaguugcugguugguauggauuccagcauucaaaugaccaagggguugguauggcagcagauagagauucaacccaaaaggcaauugauaaaauaacauccaaagugaauaauauagucgacaaaaugaacaagcaguaugaaaucauugaucaugaauucagugagguagaaacuagacuuaacaugaucaauaauaagauugaugaucaaauccaggauauaugggcauauaaugcagaauugcuaguucugcuugaaaaccagaaaacacucgaugagcaugacgcaaauguaaacaaucuauauaauaaaguaaagagggcguuggguuccaaugcgguggaagaugggaaaggauguuucgagcuauaccacaaaugugaugaccaaugcauggagacaauucggaacgggaccuacaacagaaguaaguaucaagaggagucaaaauuagaaagacagaaaauagagggggucaagcuggaaucugaaggaacuuacaaaauccucaccauuuauucgacugucgccucaucucuugugauugcaaugggguuugcugccuucuuguucugggccauguccaaugggucuugcagaugcaacauuuguauauaa

SEQ ID NO: 40858 - RNA, 1683 nt, Artificial Sequence
  hemagglutinin__InfluenzaA__AGR33900
auggagacaguaucacuaauaacuauacuacuaguagcaacaguaagcaaugcagauaaaaucugcaucggcuaucaaucaacaaacuccacagaaacuguggacacacuaacagaaaacaaugucccugugacacaugccaaagaacugcuccacacagagcauaaugggaugcugugugcaacaagcuugggacaaccucuuauuuuagacaccugcaccauugaagggcuaaucuauggcaauccuucuugugaucuauugcuggaaggaagagaaugguccuauaucgucgagagaccaucagcuguuaacggauuguguuaccccgggaauguagagaaucuagaagagcuaaggucacuuuuuaguucugcuaggucuuaucaaagaauccagauuuucccagacacaaucuggaaugugucuuacaaugggacaagcaaagcaugcucagguucauucuacagaagcaugagaugguugacucaaaagaacagcgauuacccuauucaagacgcccaauacacaaauaaucaagggaagaacauucuuuucauguggggcauaaaucacccacccaccgauacuacgcagagagaucuguacacgagaaccgacacaacaacgaguguggcaacagaagaaauaaauaggaucuucaaaccauugauuggaccaaggccucuugucaacgguuugaugggaagaauugauuauuauuggucaguauugaaaccgggucaaacacugcgaauaaaaucugaugggaaucuaauagcuccaugguauggacacauucuuucaggagagagccacggaagaauucugaagacugauuuaaaaaaggguagcugcacagugcaaugucagacagagaaagguggcuuaaacacaacauugccauuccaaaauguaaguaaguaugcauuuggaaacugcucaaaguacauuggcauaaagagucucaaacuugcaguuggucugaggaaugugccuucuagaucuaguagaggauuauucggggccauagcaggguuuauagagggagguuggucaggacuaguugcugguugguauggguuccagcauucaaaugaccaagggguugguauggcagcagauagagacucaacccaaaaggcaauugauaaaauaacauccaaagugaauaauauagucgacaaaaugaacaagcaguaugaaaucauugaucaugaauucagugagguagaaacuagacuuaacaugaucaauaauaagauugaugaucaaauccaggauauaugggcauauaaugcagaauugcuaguucugcuugaaaaccagaaaacacucgaugagcaugacgcaaauguaaacaaucuauauaauaaaguaaagagggcguuggguuccaaugcgguggaagaugggaaaggauguuucgaucuauaccacaaaugugaugaccaaugcauggagacaauucggaacgggaccuacaacagaaggaaguaucaagaggagucaaaauuagaaagacagaaaauagagggggucaagcuggaaucugaaggaacuuacaaaauccucaccauuuauucgacugucgccucaucucuugugauugcaaugggguuugcugccuucuuguucugggccauguccaaugggucuugcagaugcaacauuuguauauaa

SEQ ID NO: 40859 - RNA, 1683 nt, Artificial Sequence
  hemagglutinin__InfluenzaA__AGR33902
auggagacagcaucacuaauaacuauacuacuaguagcaacaguaagcaaugcagauaaaaucugcaucggcuaucaaucaacaaacuccacagaaacuguggacacacuaacagaaaacaaugucccugugacacaugccaaagaacugcuccacacagagcauaaugggaugcugugugcaacaagcuugggacaaccucuuauuuuagacaccugcaccauugaagggcuaaucuauggcaauccuucuugugaucuauugcuggaaggaagagaaugguccuauaucgucgagagaccaucagcuguuaacggauuguguuaccccgggaauguagaaaaucuagaagagcuaaggucacuuuuuaguucugcuaggucuuaucaaagaauccagaucuucccagacaccaccuggaaugugucuuacaaugggauaagcaaagcaugcucagguucauucuacagaagcaugagaugguugacucaaaagaacagcaauuacccuauccaagacgcccaauacacaaauaaucaagggaagaacauucuuuucauguggggcauaaaucacccacccaccgauacuacgcagagagaucuguacacgagaaccgacacaacaacgaguguggcaacagaagaaauaaauaggaucuucaaaccauugauaggaccaaggccucuugucaacgguuugaugggaagaauugauuauuauuggucgguauugaaaccgggucaaacacugcgaauaaaaucugaugggaaucuaauagcuccaugguauggacacauucuuucaggagagagccacggaagaauucugaagacugauuuaaagagggguagcugcacagugcaaugucagacagagaaagguggcuuaaacacaacauugccauuccaaaauguaaguaaguaugcauuuggaaacugcucaaaauacauuggcauaaagagucucaaacuugcaguuggucugaggaaugugccuucuagaucuaguagaggacuauucggggccauagcaggguuuauagagggagguuggucaggacuaguugcugguugguauggguuccagcauucaaaugaccaagggguugguauggcagcagauagagacucaacccaaaaggcaauugauaaaauaacauccaaagugaauaauauagucgacaaaaugaacaagcaguaugaaaucauugaucaugaauucagugagguagaaacuagacuuaacaugaucaauaauaagauugaugaucaaauccaggauauaugggcauauaaugcagaauugcuaguucugcuugaaaaccagaaaacacucgaugagcaugacgcaaauguaaacaaucuauauaauaaaguaaagagggcguuggguuccaaugcgguggaagaugggaaaggauguuucgagcuauaccacaaaugugauaaccaaugcauggagacaauucggaacgggaccuacaacagaaggaaguaucaagaggagucaaaauuagaaagacagaaaauagagggggucaagcuggaaucugaaggaacuuacaaaauccucaccauuuauucgacugucgccucaucucuugugauugcaaugggguuugcugccuucuuguucugggccauguccaaugggucuugcagaugcaacauuuguauauag

SEQ ID NO: 40860 - RNA, 1698 nt, Artificial Sequence; identical to SEQ ID NO: 36035
  hemagglutinin__InfluenzaA__AGR49817

SEQ ID NO: 40861 - RNA, 1698 nt, Artificial Sequence
  hemagglutinin__InfluenzaA__AGR49841
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaagagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaguugaccaaaagacccucuaccguacagaaaaugcuuauguuucuguagugucuucacauuauagcagaaaauucaccccagaaauagccaaaagacccaaaguaagagaccaagaaggaagaaucaacuacuacuggacucugcuugaacccagggauacaauaauauuugaggcaaauggaaaucuaauagcgccaagauaugcuuucgcacugaguagaggcuuuggaucaggaaucaucaacucaaaugcaccaauggguaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaauaggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 40862 - RNA, 1698 nt, Artificial Sequence; identical to SEQ ID NO: 36035
  hemagglutinin__InfluenzaA__AGR49853

SEQ ID NO: 40863 - RNA, 1698 nt, Artificial Sequence
  hemagglutinin__InfluenzaA__AGR49865
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacaaucacaauggaaaacuaugucuauuaaaaggaauagccccacuacaauuggguaacugcagcguugccggguggaucuuaggaaacccagaaugcgaauuauugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaguuaaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaauagaggcuuuggaucagggaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacguuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 40864 - RNA, 1701 nt, Artificial Sequence; identical to SEQ ID NO: 33168
  hemagglutinin__InfluenzaA__AGR49877

SEQ ID NO: 40865 - RNA, 1701 nt, Artificial Sequence
  hemagglutinin__InfluenzaA__AGR49888
augaagacuaucauugcuuugagcuacauucuaugucugguuuucgcucaaaaacuuccuggaaaugacaacagcacugcgacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacaguaucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauccaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauugaacaaccgguuccagaucaaggggguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40866 - RNA, 1701 nt, Artificial Sequence
  hemagglutinin__InfluenzaA__AGR49900
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaaaaaaugggaccuuuuuguugaacgcagcaaagccuacagcaaauguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaacugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacccaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40867 - RNA, 1701 nt, Artificial Sequence
  hemagglutinin__InfluenzaA__AGR49912
augaagacuaucauugcuuugagcuacauucuaugucugguuuccgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucaucuggcacacuggaguuuaacaaugaaagcuucaauuggacuggagucacucaaaacggaacaagcucugcuugcauaaggagaucuaauaacaguuucuuuaguagacugaauugguugacccacuuaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaaccguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucuaaaugcaucacuccaaauggaagcauucccaaugacaaaccauuccaaaauguaaacaggaucacauacggggccugucccagauaugugaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40868 - RNA, 1701 nt, Artificial Sequence
  hemagglutinin__InfluenzaA__AGR49924
augaagacuaucauugcuuugagcuacauucuaugucugguuuccgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucaucuggcacacuggaguuuaacaaugaaagcuucaauuggacuggagucacucaaaacggaacaagcucugcuugcauaaggagaucuaauaacaguuucuuuaguagacugaauugguugacccacuuaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaaccguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucuaaaugcaucacuccaaauggaagcauucccaaugacaaaccauuccaaaauguaaacaggaucacauacggggccugucccagauaugugaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcagucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40869 - RNA, 1701 nt, Artificial Sequence
  hemagglutinin__InfluenzaA__AGR49936
augaagacuaucauugcuuugagcuacauucuaugucugauuuccgcucaaaaauuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggguuaugccucccuuaggucacuaguugccucaucuggcacacuggaguuuaacaaugaaagcuucaauuggacuggagucacucaaaacggaacaagcucugcuugcauaaggagaucuaacaacaguuucuuuaguagacugaauugguugacccacuuaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40870 - RNA, 1701 nt, Artificial Sequence
  hemagglutinin__InfluenzaA__AGR49948
augaagacuaucauugcuuugagcuacauucuaugucugguuuccgcucaaaaacuuccuggaaaugacaacagcacggcaacacugugccuugggcaccaugcaguaccaaacggaacgauagugaaaacaaucacgaaugaccaaauugaaguuacuaaugcuacugagcugguucagaguuccucaacaggugaaauaugcgacaguccucaucagguccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucaucuggcacacuggaguuuaacaaugaaagcuucaauuggacuggagucacucaaaacggaacaagcucugcuugcauaaggagauccaauaacaguuucuuuaguagacugaauugguugacccacucaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacugugaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucuaaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgagguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40871 - RNA, 1701 nt, Artificial Sequence
  hemagglutinin__InfluenzaA__AGR49960
augaagacuaucauugcuuugagcuacauucuaugucugguuucugcucaaaaauuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucaucuggcacacuggaguuuaacaaugaaagcuucaauuggacuggagucacucaaaacggaacaagcucugcuugcauaaggagaucuaauaacaguuucuuuaguagacugaauugguugacccacuuaaaauucaaauacccagcauugaacgugaccaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuuaauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40872 - RNA, 1701 nt, Artificial Sequence
  hemagglutinin__InfluenzaA__AGR49972
augaaggcaauacuaguaguucugcuauauacauuugcaaccgcaaaugcagacacauuauguauagguuaucaugcgaacaauucaacagacacuguagacacgguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacaauaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40873 - RNA, 1698 nt, Artificial Sequence; identical to SEQ ID NO: 37202
  hemagglutinin__InfluenzaA__AGR49983

SEQ ID NO: 40874 - RNA, 1698 nt, Artificial Sequence; identical to SEQ ID NO: 37202
  hemagglutinin__InfluenzaA__AGR49995

SEQ ID NO: 40875 - RNA, 1701 nt, Artificial Sequence
  hemagglutinin__InfluenzaA__AGR50007
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucguacuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaaggaggguggacagggaugguagauggaugguacgguuaucaccaucaaaaugagcaggggucaggauaugcagccgaccugaagagcacacaaaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40876 - RNA, 1701 nt, Artificial Sequence; identical to SEQ ID NO: 33168
  hemagglutinin__InfluenzaA__AGR50018

SEQ ID NO: 40877 - RNA, 1701 nt, Artificial Sequence; identical to SEQ ID NO: 33197
  hemagglutinin__InfluenzaA__AGR50029

SEQ ID NO: 40878 - RNA, 1701 nt, Artificial Sequence
  hemagglutinin__InfluenzaA__AGR50040
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucggaaaaaccaacgagaaauuccaucagauugaaaaggaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaaaaagcaacugagggaaaaugcugaggauaugggcaaugguuguuucaaaauauaccacaaaugugacaaugccugcaugggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40879 - RNA, 1701 nt, Artificial Sequence
  hemagglutinin__InfluenzaA__AGR50052
augaaggcaauacuaguaguuuugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucguacuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauuugcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaaggaggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40880 - RNA, 1701 nt, Artificial Sequence
  hemagglutinin__InfluenzaA__AGR50063
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugagucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucguacuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaaggaggauggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40881 - RNA, 1701 nt, Artificial Sequence
  hemagglutinin__InfluenzaA__AGR50074
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugaggaaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40882 - RNA, 1701 nt, Artificial Sequence; identical to SEQ ID NO: 33168
  hemagglutinin__InfluenzaA__AGR50085

SEQ ID NO: 40883 - RNA, 1701 nt, Artificial Sequence; identical to SEQ ID NO: 33168
  hemagglutinin__InfluenzaA__AGR50096

SEQ ID NO: 40884 - RNA, 1701 nt, Artificial Sequence; identical to SEQ ID NO: 33168
  hemagglutinin__InfluenzaA__AGR50107

SEQ ID NO: 40885 - RNA, 1701 nt, Artificial Sequence; identical to SEQ ID NO: 33390
  hemagglutinin__InfluenzaA__AGR50118

SEQ ID NO: 40886 - RNA, 1701 nt, Artificial Sequence
  hemagglutinin__InfluenzaA__AGR50129
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggacaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40887 - RNA, 1701 nt, Artificial Sequence
  hemagglutinin__InfluenzaA__AGR50140
augaaggcaauacuaguaguuuugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40888 - RNA, 1701 nt, Artificial Sequence; identical to SEQ ID NO: 33355
  hemagglutinin__InfluenzaA__AGR50151

SEQ ID NO: 40889 - RNA, 1698 nt, Artificial Sequence
  hemagglutinin__InfluenzaA__AGR50162
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaagagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaguugaccaaaagacccucuaccguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggguaaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacaaggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 40890 - RNA, 1701 nt, Artificial Sequence; identical to SEQ ID NO: 33315
  hemagglutinin__InfluenzaA__AGR50174

SEQ ID NO: 40891 - RNA, 1701 nt, Artificial Sequence; identical to SEQ ID NO: 33239
  hemagglutinin__InfluenzaA__AGR50185

SEQ ID NO: 40892 - RNA, 1701 nt, Artificial Sequence; identical to SEQ ID NO: 33168
  hemagglutinin__InfluenzaA__AGR50196

SEQ ID NO: 40893 - RNA, 1701 nt, Artificial Sequence
  hemagglutinin__InfluenzaA__AGR50207
augaaggcaauacuaguaguucugcuauauacauuugcaaccgcaaaugcagacacauuauguauagguuaucaugcgaacaauucaacagacacuguggacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaaaucauacccaaagcucagcaaauccuacauuaaugauaaagggaaagaaguccucguacuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaaggaggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40894 - RNA, 1701 nt, Artificial Sequence
  hemagglutinin__InfluenzaA__AGR50218
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaucuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40895 - RNA, 1701 nt, Artificial Sequence
  hemagglutinin__InfluenzaA__AGR50229
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaaucuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40896 - RNA, 1701 nt, Artificial Sequence
  hemagglutinin__InfluenzaA__AGR50240
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguugaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuaugggguauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40897 - RNA, 1701 nt, Artificial Sequence
  hemagglutinin__InfluenzaA__AGR50251
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaagagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaaaaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugauucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40898 - RNA, 1701 nt, Artificial Sequence
  hemagglutinin__InfluenzaA__AGR50262
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaaaaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40899 - RNA, 1701 nt, Artificial Sequence; identical to SEQ ID NO: 33168
  hemagglutinin__InfluenzaA__AGR50273

SEQ ID NO: 40900 - RNA, 1701 nt, Artificial Sequence
  hemagglutinin__InfluenzaA__AGR50284
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauucaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40901 - RNA, 1701 nt, Artificial Sequence; identical to SEQ ID NO: 33903
  hemagglutinin__InfluenzaA__AGR50295

SEQ ID NO: 40902 - RNA, 1701 nt, Artificial Sequence; identical to SEQ ID NO: 33168
  hemagglutinin__InfluenzaA__AGR50306

SEQ ID NO: 40903 - RNA, 1701 nt, Artificial Sequence; identical to SEQ ID NO: 33315
  hemagglutinin__InfluenzaA__AGR50317

SEQ ID NO: 40904 - RNA, 1701 nt, Artificial Sequence
  hemagglutinin__InfluenzaA__AGR50328
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaaaucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40905 - RNA, 1701 nt, Artificial Sequence
  hemagglutinin__InfluenzaA__AGR50339
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacauccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40906 - RNA, 1701 nt, Artificial Sequence
  hemagglutinin__InfluenzaA__AGR50350
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggaucaugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagggaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40907 - RNA, 1698 nt, Artificial Sequence
  hemagglutinin__InfluenzaA__AGR50361
augaaaguacaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaagagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaguugaccaaaagacccucuaccguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggguaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 40908 - RNA, 1701 nt, Artificial Sequence
  hemagglutinin__InfluenzaA__AGT18718
augaagguaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucguacuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaauagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40909 - RNA, 1701 nt, Artificial Sequence
  hemagglutinin__InfluenzaA__AGT18720
augaagguaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaaggcaaguucauggcccaaucaugacucaaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaaauacgacugcggaccaacaaagucucuaucagaaugcagaugcauauguuuuuguggggacaucaagauacagcaagaaguucaagccggaaauagcaauaagacccaaagugagggaucaagaaaggagaaugaacuauuacuggacacuaauagagccgggagacaaaauaacauucgaagcaacuggaaaucuagugguaccgagauaugcauucgcaauggaaagaaaugcuggaucugguauuaucauuucagacacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaaggacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40910 - RNA, 1701 nt, Artificial Sequence
  hemagglutinin__InfluenzaA__AGT18721
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucaauacaaaggucugagauaugcaccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucguacuguggggcauucaccaucaaaauagcaggggucaccaacaaagucucuaucagaaugcagaugcauauguuuuuguggggacaucaagauacagcaagaaguucaagccggaaauagcaauaagacccaaagugaaggaacaagacggcagaauggacuauuacuggacacuaauagagccgggagacaaaauaacauucgaagcaacuggaaaucuagugguaccgagauaugcauucgcaauggaaagaaaugcuggaucugguauuaucauuucagauacaccaguccacgauugcaacacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagauggaguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40911 - RNA, 1701 nt, Artificial Sequence
  hemagglutinin__InfluenzaA__AGT18722
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaaaucaaacaacagaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagguaggaugaacuauuacuggacacuaauagagccgggagacaaaauaacauucgaagcaacuggaaaucuagugguaccgagauaugcauucgcaauggaaagaaaugcuggaucugguauuaucauuucagauacaccaguccacgauugcaacacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40912 - RNA, 1701 nt, Artificial Sequence
  hemagglutinin__InfluenzaA__AGT18723
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaaaacaaacaacagaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccaucaaaauaagaaggcggaacaacaaacacccuaucagaaugcagaugcauauguuuuuguggggacaucaagauacagcaagaaguucaagccggaaauagcaauaagacccaaagugagggaucaagaagguaggauggacuauuacuggacacuaauagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauucauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40913 - RNA, 1701 nt, Artificial Sequence
  hemagglutinin__InfluenzaA__AGT18724
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagucccauugcauuuggguaaauguaacauugcuggcuggauccugggaaauccagagugugaaucacucuccacagcaaguucaugguccuacauuguggaaacaucuaaaacaaacaacagaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaacacucuaucagaaugcagaugcauauguuuuuguggggacaucaagauacagcaagaaguucaagccggaaauagcaauaagacccaaagugagggaucaagaagggagaaugaacuauuaccggacacuaauagagccggaaaacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugcuauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40914 - RNA, 1701 nt, Artificial Sequence
  hemagglutinin__InfluenzaA__AGT18725
augaagguaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucgaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucguacuguggggcauucaccauccaucuacuagugcugaccaacaaagucucuaucagaaugcagacgcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaacccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40915 - RNA, 1701 nt, Artificial Sequence
  hemagglutinin__InfluenzaA__AGT18734
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagaccaaaagugagggaucaagaagggagaauuaacuauuacuggacacuaauagagccgggagacaaaauaacauucgaagcaacuggaaaucuagugguaccgagauaugcauucgcaauggaaagaaaugcuggaucugguauuaucauuucagauacaccaguccacgauugcaacacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40916 - RNA, 1701 nt, Artificial Sequence
  hemagglutinin__InfluenzaA__AGT18735
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaauagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40917 - RNA, 1701 nt, Artificial Sequence
  hemagglutinin__InfluenzaA__AGT18748
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugaugaggaaaacugcacacuaauagaugcucuauugggagacccucagugugaugacuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcagaaggggaucuaauaguaguuucuuuaguagauuaaauugguugacccacuuaaacuucaaauacccagcauugaacgugacuaugccaaacaaugaacaauuugacaaauuguacauuugggggguucaccacccgaguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaaugugccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaauugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40918 - RNA, 1701 nt, Artificial Sequence
  hemagglutinin__InfluenzaA__AGT18749
augaagacuaucauugcuuugagcuacauucuaugucugguuuucgcucaaaaacuuccugaaaaugacaacagcacggcaacgcugugccuugggcaccaugcaguaccaaacggaacgauagugaaaacaaucacggaugaccaaauugaaguuacuaaugcuacugagcugguucagaauuccucaacaggugaaauaugugacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggaguuacucaaaacgggacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucagaauacgaagugggagaagcucaauaaugagaucagaugcacccauuggcaaaugcaauucugaaugcaucacuccaaauggaagcauucccaaugacaaaccauuccaaaauguaaacaggaucacauacggggccugccccagauauguuaagcaaaacacccugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagagggcaagcagcagaucucaaaagcacucaagcagcaaucgaucaaaucaaugggaagcugaauagauugaucgggaaaaccaaugagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40919 - RNA, 1701 nt, Artificial Sequence
  hemagglutinin__InfluenzaA__AGT18751
augaagacugucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggagaagcucaauaaugagaucagaugcacccauuggcaaaugcaauucugaaugcaucacuccaaauggaagcauucccaaugacaaaccauuccagaauguaaacaggaucacauacggggccugccccagauauguuaagcaaaacacccugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaagucggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40920 - RNA, 1701 nt, Artificial Sequence
  hemagglutinin__InfluenzaA__AGT18752
augaagacuaucauugcuuugagcuacauuauaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcaacaguccucaucagauacuugauggagaaaacugcacacuaauagaugcucuauugggagacccucagugugauggcuuccaaaauaagaaaugggaccuuuuuguugaacgaagcaaagccuacagcaacuguuaccccuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccagguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggagaagcucaauaaugagaucagaugcacccauuggcaaaugcaauucugaaugcaucacuccaaauggaagcauucccaaugacaaaccauuccaaaauguaaacaggaucacauacggggccugccccagauauguuaagcaaaacacccugaaauuggcaacaggaaugcgaaauguaccagagaaacaaacuagaggcauauuuggugcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacagcucggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40921 - RNA, 1701 nt, Artificial Sequence
  hemagglutinin__InfluenzaA__AGT18753
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcaacaguccucaucagauacuugauggagaaaacugcacacuaauagaugcucuauugggagacccucagugugauggcuuccaaaauaagaaaugggaccuuuuuguugaacgaagcaaagccuacagcaacuguuaccccuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccagguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggagaagcucaauaaugagaucagaugcacccauuggcaaaugcaauucugaaugcaucacuccaaauggaagcauucccaaugacaaaccauuccaaaauguaaacaggaucacauacggggccugccccagauauguuaagcaaaacacccugaaauuggcaacaggaaugcgaaauguaccagagaaacaaacuagaggcauauuuggugcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaagucggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40922 - RNA, 1701 nt, Artificial Sequence
  hemagglutinin__InfluenzaA__AGT18754
augaagacuaucauugcuuugagcuacauucuaugucugguuuucgcucaaaaacuuccugaaaaugacaacagcacggcaacgcugugccuugggcaccaugcaguaccaaacggaacgauagugaaaacaaucacggaugaccaaauugaaguuacuaaugcuacugagcugguucagaauuccucaacaggugaaauaugugacaguccucaucagauccuugauggagaaaacugcacacuaauagaugcucuauugggagacccucagugugauggcuuccaaaauaagaaaugggaccuuuuuguugaacgaggcaaagccuacagcaacuguuacccuuaugaugugccggauuaugccucccucaggucacuaguugccacauccggcacacuggaguuuaacaaugaaagcuucaauuggacuggagucacucaaaacgggacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggagaagcucaauaaugagaucagaugcacccauuggcaaaugcaauucugaaugcaucacuccaaauggaagcauucccaaugacaaaccauuccaaaauguaaacaggaucacauacggggccugccccagauauguuaagcaaaacacccugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagagggcaagcagcagaucucaaaagcacucaagcagcaaucgaucaaaucaaugggaagcugaauagauugaucgggaaaaccaaugagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40923 - RNA, 1701 nt, Artificial Sequence
  hemagglutinin__InfluenzaA__AGT18756
augaagacuaucauugcuuugagcuacguucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugaugacuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcagaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaaugugccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaagucggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40924 - RNA, 1701 nt, Artificial Sequence
  hemagglutinin__InfluenzaA__AGT18757
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugaugacuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcagaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaaugugccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40925 - RNA, 1701 nt, Artificial Sequence
  hemagglutinin__InfluenzaA__AGT18758
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugaugacuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugccugcagaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaaugugccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacagcucggagcuucuuguugcccuggagaaccaacauacaauugaucuaacugacucagaaaugaacaaacuguuugaaaaaacaaagaagcaauugagggaaaaugcugaggauaugggcaaugguuguuucaaaauauaccacaaaugugacaauaccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugguuuguguugcuuuguugggguucaucaugugggccugccaaaagggcaacauuaggugcaacauuugcauuuga

SEQ ID NO: 40926 - RNA, 1701 nt, Artificial Sequence
  hemagglutinin__InfluenzaA__AGT18759
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugaugacuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugccugcagaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaaugugccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacagcucggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugguuuguguugcuuuguugggguucaucaugugggccugccaaaagggcaacauuaggugcaacauuugcauuuga

SEQ ID NO: 40927 - RNA, 1701 nt, Artificial Sequence
  hemagglutinin__InfluenzaA__AGT18760
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugaugacuuucaaaauaagaaaugggaccuuuuuguugaacgaaacaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcagaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaaugugccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaagucggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugguuuguguugcuuuguugggguucaucaugugggccugccaaaagggcaacauuaggugcaacauuugcauuuga

SEQ ID NO: 40928 - RNA, 1701 nt, Artificial Sequence
  hemagglutinin__InfluenzaA__AGT18761
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugaugacuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcagaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaaugugccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacagcucggaguuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugguuuguguugcuuuguugggguucaucaugugggccugccaaaagggcaacauuaggugcaacauuugcauuuga

SEQ ID NO: 40929 - RNA, 1701 nt, Artificial Sequence
  hemagglutinin__InfluenzaA__AGT37102
auggaagcaaaacuaguuguacuauucugugcauucacuacacugaaagcugacaucauuuguguaggcuaccaugcuaacaauuccacagacacugucgacacaauaauggagaagaaugugacugucacccauucgguuaauuuacuagaaaacagccauaauggaaaacucugcagccugaauggaaaggccccuuuacaacugggaaauugcaacguagcaggauggauccuuggcaacccagaaugugaccugcuucucaccgcaaauucguggucauacauaauagagacuucaaguucaaagaauggaacaugcuacccuggagaauucucugauuaugaggaauuaagggaguugcugaguacaguuuccucauuugaaagauuugaaauuuucccaaaagcaaccucauggccaaaucaugaaacaaccaaaggugccacaauugcgugcucccacucuggagccagcaguuuuuauaggaacuugcuauggauaguaaagaagggaaacuccuacccuaagaucagcaaaucauacacaaacaacagagggaaggaagugcuuguaaucuggggagugcaccacccuccgacugacaguagccaacaagcccucuaucagaauacccauacauauauuucaguuggaucaucaaaauacuaccaaagguucacaccaguaguagcagccagacccaaaaucagagaacaagaaggcagaaugaauuauuacuggacacuguuagaacaaggagauaccauaacuuuugaagccacuggaaacuuaauagcaccaugguacgcauuugcauuggauaugggaucuagcucuggaauuauggugucggaugcuccuguucacaauuguacuacaaagugucaaaccccucauggggccuugaaaagcaaucuuccuuuucagaauguacaucccaucacuauuggagaaugccccaaauauguuaaaagcacccaacuaagaauggcaacaggauuaaggaauauaccguccauucaauccagaggacuuuuuggggcaauugccggauucauugaaggaggauggacaggaaugauagaugguugguauggauaccaccaucaaaaugagcagggaucuggcuacgccgcagaucagaaaagcacacaaauugcgauugaugggaucagcaacaagguaaacucaauaauugaaaaaaugaacguucaauuuacuucagugggcaaggaguucaaugaucuagagaaaaggauugagaauuuaaacaagaaagucgaugauggauuuuuggauguauggacauauaacgcugaauugcucguuuugcucgaaaacgaaagaacucuagauuuccaugacuuuaacguaaaaaauuuauaugaaaaggucaaaucacaacugaggaacaaugccaaggaaaucgggaauggcuguuucgaguucuaccacaaaugugauaaugaaugcauggaaaacgugaagaauggcacuuauaauuaucccaaauauucagaagaauccaaacuaaauagagagaaaauagacgguguaaaacuagaaucaauaggaguccaccagauuuuggcgaucuacuccacagucgccaguucccugguuuuguuagucucccugggggcaaucagcuucuggauguguucuaaugggucauugcaaugcagaauaugcauuuaa

SEQ ID NO: 40930 - RNA, 1701 nt, Artificial Sequence
  hemagglutinin__InfluenzaA__AGU01877
augaaggcaauacuaguaguucugcuauacacauuugcaaccgcaaaugcagacacauuauguauagguuaucaugcgaacaauucaacagacacuguagauacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacuacugaccaacaaagucucuaucagaaugcagaugcauaugucuuuguggggacaucaagauacagcaagaaguucaagccggaaauagcaauaagacccaaagugagggaucaagaagggagaaugaacuauuacuggacacuaauagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40931 - RNA, 1701 nt, Artificial Sequence
  hemagglutinin__InfluenzaA__AGU01878
augaaggcaauacuaguaguuaugcuauauacacuugcaaccgcaaaugcagacacauuauguauagguuaucaugcgaacaauucaacagacacuguagacacaguacuagaaaagaauguaacaguaacacacucuguuaaucuucuagaagacaagcaugacgggaaacuaugcaaacuaagagggguagccccauugcauuuggguaaauguaacauugcuggcuggauccugggaaauccagagugugaaucacucuccacagcaagcucaugguccuacauuguggaaacaucugguucagacaauggaacguguuacccaggagauuucaucgauuaugaggagcuaagagagcaauugagcucagugucaucauuugaaagguuugagauauuccccaaaacaaguucauggccaaaucaugacucgaacaaagguguaacggcagcauguccucaugcuggagcaaaaggcuucuacaaaaauuuaauauggcuaguuaaaaaaggaaauucauacccaaagcucagcauauccuacauuaaugacaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauuugcaauggaaagaaaugcuggaucugguauuaucauuucagauacaccaguucacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugcuggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugauuacccaaaauacucagaggaagcaaaauuaaacagagaagaaauagaugggguaaagcuggaaucaacaaggauuuaccagauuuuggcgaucuauucaacugccgcuaguucauugguacugguagucucccugggggcaaucaguuuuuggaugugcucuaaugggucucuacaguguagaauauguauuuaa

SEQ ID NO: 40932 - RNA, 1701 nt, Artificial Sequence
  hemagglutinin__InfluenzaA__AGU01879
augaaggcaauacuaguaguuaugcuguauacauuugcaaccgcaaaugcagacacauuauguauagguuaucaugcgaacaauucaacagacacuguagacacaguacuagaaaagaauguaacaguaacacacucuguuaaucuucuagaagacaaacauaacgagaaacuaugcaaacuaagagggguagccccauugcauuuggguaaauguaacauugcuggcuggauccugggaaauccagagugugaaucacucuccacagcaagcucaugguccuacauuguggaaacaucugguucagacaauggaacguguuacccaggagauuucaucgauuaugaagagcuaagagagcaauugagcucagugucaucauuugaaagguuugagauauuccccaaaacaaguucauggcccaaucaugacucgaacaaagguguaacggcagcauguccucaagcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugccgaccaacaaagucucuaucagaaugcagauacauauguuuuuguggggacaucaagauacagcaagaaauucaagccggaaauagcaauaagacccaaaguaagggaucaagaagggagaaugaacuauuacuggacacuaguagagccgggagacaaaauaacauucgaagcaacuggaaaucuagugguaccgagauaugcauuugcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuaggggccuauuuggggccauugcuggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaauacgugcauggaaagugucaaaaaugggacuuaugacuacccaaaauacucagaggaagcaaaauuaaacagagaagaaauagaugggguaaagcuggaaucaacaaggauuuaccaaauuuuggcgaucuauucaacugucgcuaguucauugguacugguagucucccugggggcaaucaguuuuuggaugugcucuaaugggucuuuacaguguagaauauguauuuaa

SEQ ID NO: 40933 - RNA, 1701 nt, Artificial Sequence
  hemagglutinin__InfluenzaA__AGU01881
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaaacauaacgggaaacuaugcaaacuaagagggguaaccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauguuccccaagacaaguucauggcccaaucaugacucgaacaaagguguaacggcagcauguccucaggcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaauagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaaguuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40934 - RNA, 1701 nt, Artificial Sequence
  hemagglutinin__InfluenzaA__AGU01883
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucugguucagacaauggaacguguuacccaggagauuucaucgauuaugaggagcuaagagagcaauugagcucagugucaucauuugaaagguuugagauauuccccaaaacaaguucauggccaaaucaugacucgaacaaagguguaacggcagcauguccucaugcuggagcaaaaggcuucuacaaaaauuuaauauggcuaguuaaaaaaggaaauucauacccaaagcucagcauauccuacauuaauaacaaagagaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauuugcaauggaaagaaaugcuggaucugguauuaucauuucagauacaccaguucacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugcuggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaauucacugcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugauuacccaaaauacucagaggaagcaaaauuaaacagagaagaaauagaugggguaaagcuggaaucaacaaggauuuaccagauuuuggcgaucuauucaacugccgcuaguucauugguacugguagucucccugggggcaaucaguuuuuggaugugcucuaaugggucucuacaguguagaauauguauuuga

SEQ ID NO: 40935 - RNA, 1701 nt, Artificial Sequence
  hemagglutinin__InfluenzaA__AGU01884
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucugguucagacaauggaacguguuacccaggagauuucaucgauuaugaggagcuaagagagcaauugagcucagugucaucauuugaaagguuugagauauuccccaaaacaaguucauggccaaaucaugacucgaacaaagguguaacggcagcauguccucaugcuggagcaaaaggcuucuacaaaaauuuaauauggcuaguuaaaaaaggaaauucauacccaaagcucagcauauccuacauuaaugacaaaggaaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauuugcaauggaaagaaaugcuggaucugguauuaucauuucagauacaccaguucacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugcuggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaauucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugauuacccaaaauacucagaggaagcaaaauuaaacagagaagaaauagaugggguaaagcuggaaucaacaaggauuuaccagauuuuggcgaucuauucaacugccgcuaguucauugguacugguagucucccugggggcaaucaguuuuuggaugugcucuaaugggucucuacaguguagaauauguauuuaa

SEQ ID NO: 40936 - RNA, 1701 nt, Artificial Sequence
  hemagglutinin__InfluenzaA__AGU01885
augaaggcaauacuaguaguuaugcuguauacauuugcaaccgcaaaugcagacacauuauguauagguuaucaugcgaacaauucaacagacacuguagacacaguacuagaaaagaauguaacaguaacacacucuguuaaucuucuagaagacaaacauaacgagaaacuaugcaaacuaagagggguagccccauugcauuuggguaaauguaacauugcuggcuggauccugggaaauccagagugugaaucacucuccacagcaagcucaugguccuacauuguggaaacaucugguucagacaauggaacguguuacccaggagauuucaucgauuaugaagagcuaagagagcaauugagcucagugucaucauuugaaagguuugagauauuccccaaaacaaguucauggcccaaucaugacucgaacaaagguguaacggcagcauguccucaagcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugccgaccaacaaagucucuaucagaaugcagauacauauguuuuuguggggacaucaagauacagcaagaaauucaagccggaaauagcaauaagacccaaaguaagggaucaagaagggagaaugaacuauuacuggacacuaguagagccgggagacaaaauaacauucgaagcaacuggaaaucuagugguaccgagauaugcauuugcaauggaaagaaaugcuggaucugguauuaucauuucagauacaccaguccacgauugcaauacaacuugucagacacccaagggugcuauaaacaccagccucccauuucagaauguacauccgaucacaauuggaaaauguccaaaauauguaaaaagcacaaaauugagacuggccacaggauugaggaaugucccgucuauucaaucuaggggccuauuuggggccauugcuggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaauacgugcauggaaagugucaaaaaugggaccuaugacuacccaaaauacucagaggaagcaaaauuaaacagagaagaaauagaugggguaaagcuggaaucaacaaggauuuaccaaauuuuggcgaucuauucaacugucgcuaguucauugguacugguagucucccugggggcaaucaguuuuuggaugugcucuaaugggucuuuacaguguagaauauguauuuaa

SEQ ID NO: 40937 - RNA, 1701 nt, Artificial Sequence
  hemagglutinin__InfluenzaA__AGU01887
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaucaacaaagucucuaucagaaugcagaugcauauguuuuuguggggacaucaagauacagcaaaaaguucaagccggaaauagcaauaagaccuaaagugagggaucaagaagggagaaugaacuauuacuggacacuaauagagccgggagacaaaauaacauucgaagcaacuggaaaucuagugguaccgagauaugcauucgcaguggaaagaaaugcuggaucugguauuaucauuucagauacaccaguccacaauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40938 - RNA, 1701 nt, Artificial Sequence
  hemagglutinin__InfluenzaA__AGU01888
augaaggcaauacuaguaguuaugcuguauacauuugcaaccgcaaaugcagacacauuauguauagguuaucaugcgaacaauucaacagacacuguagacacaguacuagaaaagaauguaacaguaacacacucuguuaaucuucuagaagacaaacauaacgggaaacuaugcaaacuaagagggguagccccauugcauuuggguaaauguaacauugcuggcuggauccugggaaauccagagugugaaucacucuccacagcaagcucaugguccuacauuguggaaacaucugguucagacaauggaacguguuacccaggagauuucaucgauuaugaagagcuaagagagcaauugagcucagugucaucauuugaaagguuugagauauuccccaaaacaaguucauggcccaaucaugacucgaacaaagguguaacggcagcauguccucaagcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugccgaccaacaaagucucuaucagaaugcagauacauauguuuuuguggggacaucaagauacagcaagaaauucaagccggaaauagcaauaagacccaaaguaagggaucaagaagggagaaugaacuauuacuggacacuaguagagccgggagacaaaauaacauucgaagcaacuggaaaucuagugguaccgagauaugcauuugcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuaggggccuauuuggggccauugcuggcuucauugaagggggguggacaggaaugguagauggaugguacgguuaucaccaucaaaaugagcaggggucaggauaugcagccgaccugaagagcacacagaaugccauugacaagauuacuaacaaaguaaauucuguuauugaaaagaugaauacacgguucacagcaguagguaaagaguucaaccaccuggaaaaaagaauagagaauuugaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccaaauuuuggcgaucuauucaacugucgcuaguucauugguacugguagucucccugggggcaaucaguuuuuggaugugcucuaaugggucuuuacaguguagaauauguauuuaa

SEQ ID NO: 40939 - RNA, 1701 nt, Artificial Sequence
  hemagglutinin__InfluenzaA__AGU01889
augaaggcaauacuaguaguucugcuauacacauuugcaaccgcaaaugcagacacauuauguauagguuaucaugcgaacaauucaacagacacuguagauacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacuacugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaauagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40940 - RNA, 1701 nt, Artificial Sequence
  hemagglutinin__InfluenzaA__AGU01890
augaaggcaauacuaguaguuaugcuguauacauuugcaaccgcaaaugcagacacauuauguauagguuaucaugcgaacaauucaacagacacuguagacacaguacuagaaaagaauguaacaguaacacacucuguuaaucuucuagaagacaaacauaacgggaaacuaugcaaacuaagagggguagccccauugcauuuggguaaauguaacauugcuggcuggauccugggaaauccagagugugaaucacucuccacagcaagcucaugguccuacauuguggaaacaucugguucagacaauggaacguguuacccaggagauuucaucgauuaugaagagcuaagagagcaauugagcucagugucaucauuugaaagguuugagauauuccccaaaacaaguucauggcccaaucaugacucgaacaaagguguaacggcagcauguccucaagcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugccgaccaacaaagucucuaucagaaugcagauacauauguuuuuguggggacaucaagauacagcaagaaauucaagccggaaauagcaauaagacccaaaguaagggaucaagaagggagaaugaacuauuacuggacacuaguagagccgggagacaaaauaacauucgaagcaacuggaaaucuagugguaccgagauaugcauuugcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuaggggccuauuuggggccauugcuggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaauaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccaaauuuuggcgaucuauucaacugucgcuaguucauugguacugguagucucccugggggcaaucaguuuuuggaugugcucuaaugggucuuuacaguguagaauauguauuuaa

SEQ ID NO: 40941 - RNA, 1701 nt, Artificial Sequence
  hemagglutinin__InfluenzaA__AGU92645
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaacacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccauccaccacugcugaccaacaaagucucuaucagaaugcagauacauauguuuuuguggggacaucaagauacagcaagaaguucaagccggaaauagaaacaagacccaaagugagggaucaagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucaaaauauacauccgaucacaauuggaaaauguccaaaauauguaaaaagcacaaaauugagacuggccacaggauugaggaaugucccaucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaaaaugaauacacaguucacagcaguagguaaagaguucaaccaccuggaaaaaagaauagagaauuuaaauaaaaaaguugaugauggguuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacguguauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuuuuggaugugcucuaaugggucucuacaguguagaauauguauuuaa

SEQ ID NO: 40942 - RNA, 1701 nt, Artificial Sequence
  hemagglutinin__InfluenzaA__AGU92667
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaacacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccauccaccacugcugaccaacaaagucucuaucagaaugcagauacauauguuuuuguggggacaucaagauacagcaagaaguucaagccggaaauagcaacaagacccaaagugagggaucaagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucaaaauauacauccgaucacaauuggaaaauguccaaaauauguaaaaagcacaaaauugagacuggccacaggauugaggaaugucccaucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaaaaugaauacacaguucacagcaguagguaaagaguucaaccaccuggaaaaaagaauagagaauuuaaauaaaaaaguugaugauggguuccuggacauuuggacuuacaaugccgaacuguugguucuauuggaaaaugaaagagcuuuggacuaccacgauucaaaugugaagaacuuauaugaaaagguaagaaaccaguuaaaaaacaaugccaaggaaauuggaaauggcugcuuugaauuuuaccacaaaugcgauaacacguguauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuuuuggaugugcucuaaugggucucuacaguguagaauauguauuuaa

SEQ ID NO: 40943 - RNA, 1701 nt, Artificial Sequence
  hemagglutinin__InfluenzaA__AGU92678
augaaggcaauacuaguaguucugcuauauacauuugcaaccgcaaaugcagacacauuauguauaggucaccaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaacacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccauccaccacugcugaccaacaaagucucuaucagaaugcagauacauauguuuuuguggggacaucaagauacagcaagaaguucaagccggaaauagcaacaagacccaaagugagggaucaagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucaaaauauacauccgaucacaauuggaaaauguccaaaauauguaaaaagcacaaaauugagacuggccacaggauugaggaaugucccaucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaaaaugaauacacaguucacagcaguagguaaagaguucaaccaccuggaaaaaagaauagagaauuuaaauaaaaaaguugaugauggguuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacguguauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuuuuggaugugcucuaaugggucucuacaguguagaauauguauuuaa

SEQ ID NO: 40944 - RNA, 1701 nt, Artificial Sequence
  hemagglutinin__InfluenzaA__AGU92711
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaacaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacuccgaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40945 - RNA, 1701 nt, Artificial Sequence
  hemagglutinin__InfluenzaA__AGU92722
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucggacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagaaaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40946 - RNA, 1701 nt, Artificial Sequence; identical to SEQ ID NO: 40945
  hemagglutinin__InfluenzaA__AGU92733

SEQ ID NO: 40947 - RNA, 1701 nt, Artificial Sequence
  hemagglutinin__InfluenzaA__AGU92744
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucggacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagaaaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaauggggcuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40948 - RNA, 1701 nt, Artificial Sequence
  hemagglutinin__InfluenzaA__AGU92755
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaaggaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40949 - RNA, 1701 nt, Artificial Sequence
  hemagglutinin__InfluenzaA__AGU92766
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaacacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugaaucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccauccaccacugcugaccaacaaagucucuaucagaaugcagaugcauauguuuuuguggggacaucaagauacagcaagaaguucaagccggaaauagcaacaagacccaaagugagggaucaagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucaaaauauacauccgaucacaauuggaaaauguccaaaauauguaaaaagcacaaaauugagacuggccacaggauugaggaaugucccaucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaaaaugaauacacaguucacagcaguagguaaagaguucaaccaccuggaaaaaagaauagagaauuuaaauaaaaaaguugaugauggguuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacguguauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuuuuggaugugcucuaaugggucucuacaguguagaauauguauuuaa

SEQ ID NO: 40950 - RNA, 1701 nt, Artificial Sequence
  hemagglutinin__InfluenzaA__AGU92777
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaacacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugaaucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccauccaccacugcugaccaacaaaguaucuaucagaaugcagauacauauguuuuuguggggacaucaagauacagcaagaaguucaagccggaaauagcaacaagacccaaagugagggaucaagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucaaaauauacauccgaucacaauuggaaaauguccaaaauauguaaaaagcacaaaauugagacuggccacaggauugaggaaugucccaucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaaaaugaauacacaguucacagcaguagguaaagaguucaaccaccuggaaaaaagaauagagaauuuaaauaaaaaaguugaugauggguuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacguguauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuuuuggaugugcucuaaugggucucuacaguguagaauauguauuuaa

SEQ ID NO: 40951 - RNA, 1701 nt, Artificial Sequence
  hemagglutinin__InfluenzaA__AGU92788
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaacacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucggacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccauccaccacugcugaccaacaaagucucuaucagaaugcagaugcauauguuuuuguggggacaucaagauacagcaagaaguucaagccggaaauagcaacaagacccaaagugagggaucgagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucaaaauauacauccgaucacaauuggaaaauguccaaaauauguaaaaagcacaaaauugagacuggccacaggauugaggaaugucccaucuauucaaucuagaggccuauuuggggccauugccggcuucauugaagggggguggacagggauguuagauggaugguacgguuaucaccaucaaaaugagcaggggucaggauaugcagccgaccugaagagcacacagaaugccauugacaagauuacuaacaaaguaaauucuguuauugaaaaaaugaauacacaguucacagcaguagguaaagaguucaaccaccuggaaaaaagaauagagaauuuaaauaaaaaaguugaugauggguuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacguguauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuuuuggaugugcucuaaugggucucuacaguguagaauauguauuuaa

SEQ ID NO: 40952 - RNA, 1701 nt, Artificial Sequence
  hemagglutinin__InfluenzaA__AGU92799
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaacacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccgaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccauccaccacugcugaccaacaaagucucuaucagaaugcagaugcauauguuuuuguggggacaucaagauacagcaagaaguucaagccggaaauagcaacaagacccaaagugagggaucgagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucaaaauauacauccgaucacaauuggaaaauguccaaaauauguaaaaagcacaaaauugagacuggccacaggauugaggaaugucccaucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaaaaugaauacacaguucacagcaguagguaaagaguucaaccaccuggaaaaaagaauagagaauuuaaauaaaaaaguugaugauggguuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacguguauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuuuuggaugugcucuaaugggucucuacaguguagaauauguauuuaa

SEQ ID NO: 40953 - RNA, 1701 nt, Artificial Sequence
  hemagglutinin__InfluenzaA__AGU92821
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaacacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccauccaccacugcugaccaacaaagucucuaucagaaugcagauacauauguuuuuguggggacaucaagauacagcaagauguucaagccggaaauagcaacaagacccaaagugagggaucgagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucaaaauauacauccgaucacaauuggaaaauguccaaaauauguaaaaagcacaaaauugagacuggccacaggauugaggaaugucccaucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaaaaugaauacacaguucacagcaguagguaaagaguucaaccaccuggaaaaaagaauagagaauuuaaauaaaaaaguugaugauggguuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacguguauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuuuuggaugugcucuaaugggucucuacaguguagaauauguauuuaa

SEQ ID NO: 40954 - RNA, 1701 nt, Artificial Sequence
  hemagglutinin__InfluenzaA__AGU92843
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggagauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucgagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuauugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40955 - RNA, 1710 nt, Artificial Sequence
  hemagglutinin__InfluenzaA__AGU92854
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucggacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucgagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40956 - RNA, 1701 nt, Artificial Sequence
  hemagglutinin__InfluenzaA__AGU92887
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugaugaccaacaaagucucuaucagaaugcagaugcauauguuuuuguggggucaucaagauacagcaagaaguucaagccggaaauagcaauaagacccaaagugagggaucgagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40957 - RNA, 1701 nt, Artificial Sequence; identical to SEQ ID NO: 40941
  hemagglutinin__InfluenzaA__AGU92898

SEQ ID NO: 40958 - RNA, 1701 nt, Artificial Sequence; identical to SEQ ID NO: 40942
  hemagglutinin__InfluenzaA__AGU92909

SEQ ID NO: 40959 - RNA, 1701 nt, Artificial Sequence
  hemagglutinin__InfluenzaA__AGU92931
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaacaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40960 - RNA, 1701 nt, Artificial Sequence; identical to SEQ ID NO: 40945
  hemagglutinin__InfluenzaA__AGU92942

SEQ ID NO: 40961 - RNA, 1701 nt, Artificial Sequence; identical to SEQ ID NO: 40945
  hemagglutinin__InfluenzaA__AGU92953

SEQ ID NO: 40962 - RNA, 1701 nt, Artificial Sequence
  hemagglutinin__InfluenzaA__AGU92964
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaacacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccauccaccacugcugaccaacaaagucucuaucagaaugcagaugcauauguuuuuguggggacaucaagauacagcaagaaguucaagccggaaauagcaacaagacccaaagugagggaucgagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucaaaauauacauccgaucacaauuggaaaauguccaaaauauguaaaaagcacaaaauugagacuggccacaggauugaggaaugucccaucuauucaaucuagaggccuauuuggggccauugccggcuucauugaagggggguggacagggauguuagauggaugguacgguuaucaccaucaaaaugagcaggggucaggauaugcagccgaccugaagagcacacagaaugccauugacaagauuacuaacaaaguaaauucuguuauugaaaaaaugaauacacaguucacagcaguagguaaagaguucaaccaccuggaaaaaagaauagagaauuuaaauaaaaaaguugaugauggguuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacguguauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuuuuggaugugcucuaaugggucucuacaguguagaauauguauuuaa

SEQ ID NO: 40963 - RNA, 1701 nt, Artificial Sequence
  hemagglutinin__InfluenzaA__AGU92975
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaacacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaagaaaauucauacccaaagcucagcaaauccuacauuaaugauaaagggaaagaaguccucgugcuauggggcauucaccauccauccaccacugcugaccaacaaagucucuaucagaaugcagauacauauguuuuuguggggacaucaagauacagcaagaaguucaagccggaaauagcaacaagacccaaagugagggaucgagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucaaaauauacauccgaucacaauuggaaaauguccaaaauauguaaaaagcacaaaauugagacuggccacaggauugaggaaugucccaucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaaaaugaauacacaguucacagcaguagguaaagaguucaaccaccuggaaaaaagaauagagaauuuaaauaaaaaaguugaugauggguuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacguguauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuuuuggaugugcucuaaugggucucuacaguguagaauauguauuuaa

SEQ ID NO: 40964 - RNA, 1701 nt, Artificial Sequence
  hemagglutinin__InfluenzaA__AGU92986
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggagauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucgagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40965 - RNA, 1701 nt, Artificial Sequence
  hemagglutinin__InfluenzaA__AGU92997
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagauguucaagccggaaauagcaauaagacccaaagugagggaucgagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40966 - RNA, 1701 nt, Artificial Sequence; identical to SEQ ID NO: 40956
  hemagglutinin__InfluenzaA__AGU93008

SEQ ID NO: 40967 - RNA, 1698 nt, Artificial Sequence
  hemagglutinin__InfluenzaA__AGU93019
augaaggcaaaccuacugguccuguuaagugcacuugcagcugcagaugcagacacaauauguauaggcuaccaugcgaacaauucaaccgacacuguugacacaguacucgagaagaaugugacagugacacacucuguuaaccugcucgaagacagccacaacggaaaacuauguagauuaaaaggaauagccccacuacaauuggggaaauguaacaucgccggauggcucuugggaaacccagaaugcgacccacugcuuccagugagaucaugguccuacauuguagaaacaccaaacucugagaauggaauauguuauccaggagauuucaucgacuaugaggagcugagggagcaauugagcucagugucaucauucgaaagauucgaaauauuucccaaagaaagcucauggcccaaccacaacacaaacggaguaacggcagcaugcucccaugaggggaaaagcaguuuuuacagaaauuugcuauggcugacggagaaggagggcucauacccaaagcugaaaaauucuuaugugaacaaaaaagggaaagaaguccuuguacugugggguauucaucacccgccuaacaguaaggaacaacagaaucucuaucagaaugaaaaugcuuaugucucuguagugacuucaaauuauaacaggagauuuaccccggaaauagcagaaagacccaaaguaagagaucaagcugggaggaugaacuauuacuggaccuugcuaaaacccggagacacaauaauauuugaggcaaauggaaaucuaauagcaccaauguaugcuuucgcacugaguagaggcuuuggguccggcaucaucaccucaaacgcaucaaugcaugaguguaacacgaagugucaaacaccccugggagcuauaaacagcagucucccuuaccagaauauacacccagucacaauaggagagugcccaaaauacgucaggagugcuaaauugaggaugguuacaggacuaaggaacacuccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacacuguuaucgagaaaaugaacauucaauucacagcuguggguaaagaauucaacaaauuagaaaaaaggauggaaaauuuaaauaaaaaaguugaugauggauuucuggacauuuggacauauaaugcagaauuguuaguucuacuggaaaaugaaaggacucuggauuuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucuga

SEQ ID NO: 40968 - RNA, 1701 nt, Artificial Sequence
  hemagglutinin__InfluenzaA__AGU93031
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacugagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaagagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaacgauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaguaagaccuaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacgggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaaaagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaaccuauaugaaaagguaagaagccaguuaaaaaacaaugccaaggaaauuggaaauggcugcuuugaauuuuaccacaaaugcgacaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40969 - RNA, 1701 nt, Artificial Sequence
  hemagglutinin__InfluenzaA__AGU93042
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaacacucucaacagcaaacucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaagggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaaaaugaauauacaguucacagcaguagguaaagaguucaaccaccuggaaaaaagaauagagaauuuaaauaaaaaaguugaugauggguuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcuguuuugaauuuuaccacaaaugcgauaacacguguauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuuuuggaugugcucuaaugggucucuacaguguagaauauguauuuaa

SEQ ID NO: 40970 - RNA, 1701 nt, Artificial Sequence
  hemagglutinin__InfluenzaA__AGU93053
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaacacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccauccaccacugcugaccaacaaagucucuaucagaaugcagauacauauguuuuuguggggacaucaagauacagcaagaaguucaagccggaaauagcaacaagacccaaagugagggaucaagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucaaaauauacauccgaucacaauuggaaaauguccaaaauauguaaaaagcacaaaauugagacuggccacaggauugaggaaugucccaucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaaaaugaauacacaguucacagcaguagguaaagaguucaaccaccuggaaaaaagaauagagaauuuaaauaaaaaaguugaugauggguuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacguguauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuuuuggaugugcucuaaugggucucuacaguguagaauauguauuuaa

SEQ ID NO: 40971 - RNA, 1701 nt, Artificial Sequence
  hemagglutinin__InfluenzaA__AGV99014
augaagacuaucauugcuuugagcuacauucuaugucuaguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaacggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggugcaauagcggguuucauagaaaaugguugggagggaaugauggaugguugguacgguuucaggcaccaaaauucugagggaagaggacaagcagcagaucucaaaagcacucaagcagcaaucgaucaaaucaaugggaagcugaaucgauugaucgggaaaaccaacgagaaauuccaucagauugaaaaagaauuuucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40972 - RNA, 1701 nt, Artificial Sequence
  hemagglutinin__InfluenzaA__AGV99037
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaaccagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40973 - RNA, 1701 nt, Artificial Sequence
  hemagglutinin__InfluenzaA__AGV99049
augaagacuaucauugcuuugagcuacauucuaugucugguuuucgcucaaaaacuuccuggaaaugacaauagcacggcaacgcugugccuugggcaccaugcaguaccaaacggaacgguagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagauccccagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauuggcugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcaggauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgggaaauuccaucagauugaaaaagaauucucagaaguagaagggagaauucaggaccuugagaaauauguugaggacacuaaaauagaucucuggucauacaaugcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagauuaagggaguugagcugaagucaggguacaaagauuggauccuauggauuuccuuugccauaucauguuuuuugcuuuguguuguuuuguugggguucaucaugugggccugccaaaagggcaacauuaggugcaacauuugcauuuga

SEQ ID NO: 40974 - RNA, 1701 nt, Artificial Sequence
  hemagglutinin__InfluenzaA__AGV99073
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauaagaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagccaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40975 - RNA, 1701 nt, Artificial Sequence
  hemagglutinin__InfluenzaA__AGV99085
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucagacaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaguugagcuuaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40976 - RNA, 1701 nt, Artificial Sequence
  hemagglutinin__InfluenzaA__AGV99097
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccgggcacggacaaggaccaaaucuuccuguaugcucaaucaucaggaagaaucacaguaucuaccaaaagaagccaacaagcuguaaucccgaauaucgggucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagauucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40977 - RNA, 1701 nt, Artificial Sequence
  hemagglutinin__InfluenzaA__AGV99121
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaagucacuaaugcuacugagcugguucagaauuccucaauaggugaaauaugcgacaguccucaucagauccuugauggagaaaacugcacacuaauagaugcucuauugggagacccucagugugaugacuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggggucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaaccagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40978 - RNA, 1701 nt, Artificial Sequence; identical to SEQ ID NO: 40977
  hemagglutinin__InfluenzaA__AGV99133

SEQ ID NO: 40979 - RNA, 1701 nt, Artificial Sequence; identical to SEQ ID NO: 40971
  hemagglutinin__InfluenzaA__AGV99145

SEQ ID NO: 40980 - RNA, 1701 nt, Artificial Sequence
  hemagglutinin__InfluenzaA__AGV99157
augaagacuaucauugcuuugagcuacauucuaugucuaguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuauugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagauacacccauuggcaaaugcaagucugaaugcaucacuccaaacggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggugcaauagcggguuucauagaaaaugguugggagggaaugauggaugguugguacgguuucaggcaccaaaauucugagggaagaggacaagcagcagaucucaaaagcacucaagcagcaaucgaucaaaucaaugggaagcugaaucgauugaucgggaaaaccaacgagaaauuccaucagauugaaaaagaauuuucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40981 - RNA, 1701 nt, Artificial Sequence
  hemagglutinin__InfluenzaA__AGV99169
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaagucacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggggucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaaccagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40982 - RNA, 1701 nt, Artificial Sequence
  hemagglutinin__InfluenzaA__AGV99181
augaagacuaucauugcuuugagcuacauucuaugucuaguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggugcaauagcggguuucauagaaaaugguugggagggaaugauggaugguugguacgguuucaggcaccaaaauucugagggaagaggacaagcagcagaucucaaaagcacucaagcagcaaucgaucaaaucaaugggaagcugaaucgauugaucgggaaaaccaacgagaaauuccaucagauugaaaaagaauuuucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40983 - RNA, 1701 nt, Artificial Sequence
  hemagglutinin__InfluenzaA__AGV99193
augaagacuaucauugcuuugagcuacauucuaugucuaguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagauacacccauuggcaaaugcaagucugaaugcaucacuccaaacggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggugcaauagcggguuucauagaaaaugguugggagggaaugauggaugguugguacgguuucaggcaccaaaauucugagggaagaggacaagcagcagaucucaaaagcacucaagcagcaaucgaucaaaucaaugggaagcugaaucgauugaucgggaaaaccaacgagaaauuccaucagauugaaaaagaauuuucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40984 - RNA, 1701 nt, Artificial Sequence
  hemagglutinin__InfluenzaA__AGV99956
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40985 - RNA, 1701 nt, Artificial Sequence
  hemagglutinin__InfluenzaA__AGV99986
augaagacuaucauugcuuugagcuacauucuaugucuaguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaauugccucauccggcacacuggaguuuaacaaugaaagcuucaauuggacuggagucacucaaaacggaacaaguucugcuugcauaaggagaucuaauaauaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaacggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggugcaauagcggguuucauagaaaaugguugggagggaaugauggaugguugguacgguuucaggcaccaaaauucugagggaagaggacaagcagcagaucucaaaagcacucaagcagcaaucgaucaaaucaaugggaagcugaaucgauugaucgggaaaaccaacgagaaauuccaucagauugaaaaagaauuuucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40986 - RNA, 1701 nt, Artificial Sequence
  hemagglutinin__InfluenzaA__AGW00065
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuauaccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40987 - RNA, 1701 nt, Artificial Sequence; identical to SEQ ID NO: 40551
  hemagglutinin__InfluenzaA__AGW00077

SEQ ID NO: 40988 - RNA, 1701 nt, Artificial Sequence
  hemagglutinin__InfluenzaA__AGW00089
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggugccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaguugagcuuaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40989 - RNA, 1701 nt, Artificial Sequence; identical to SEQ ID NO: 40981
  hemagglutinin__InfluenzaA__AGW00101

SEQ ID NO: 40990 - RNA, 1701 nt, Artificial Sequence
  hemagglutinin__InfluenzaA__AGW00113
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugagcaauuugacaaauuguacauuugggggguucaccacccggguacggacaaggaccaaaccuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaaaucugaauguaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40991 - RNA, 1701 nt, Artificial Sequence; identical to SEQ ID NO: 40551
  hemagglutinin__InfluenzaA__AGW00125

SEQ ID NO: 40992 - RNA, 1701 nt, Artificial Sequence
  hemagglutinin__InfluenzaA__AGW00137
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaagucacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggggucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaagagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaaccagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40993 - RNA, 1701 nt, Artificial Sequence
  hemagglutinin__InfluenzaA__AGW00149
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggggacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccagguacagacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaagcuguuugaaaaaacaaagaagcaacugagggaaaaugcugaggauaugggcaaugguugcuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40994 - RNA, 1701 nt, Artificial Sequence; identical to SEQ ID NO: 40551
  hemagglutinin__InfluenzaA__AGW00161

SEQ ID NO: 40995 - RNA, 1701 nt, Artificial Sequence; identical to SEQ ID NO: 40981
  hemagglutinin__InfluenzaA__AGW00173

SEQ ID NO: 40996 - RNA, 1701 nt, Artificial Sequence
  hemagglutinin__InfluenzaA__AGW00185
augaagacuaucauugcuuugagcuacauucuaugucuaguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuauugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaacggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggugcaauagcggguuucauagaaaaugguugggagggaaugauggaugguugguacgguuucaggcaccaaaauucugagggaagaggacaagcagcagaucucaaaagcacucaagcagcaaucgaucaaaucaaugggaagcugaaucgauugaucgggaaaaccaacgagaaauuccaucagauugaaaaagaauuuucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40997 - RNA, 1701 nt, Artificial Sequence
  hemagglutinin__InfluenzaA__AGW00709
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaagucacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggggucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaaccagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40998 - RNA, 1701 nt, Artificial Sequence; identical to SEQ ID NO: 40981
  hemagglutinin__InfluenzaA__AGW00721

SEQ ID NO: 40999 - RNA, 1701 nt, Artificial Sequence; identical to SEQ ID NO: 40981
  hemagglutinin__InfluenzaA__AGW00733

SEQ ID NO: 41000 - RNA, 1701 nt, Artificial Sequence
  hemagglutinin__InfluenzaA__AGW00745
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaagucacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggggucacucaaaacggaacaaguucugcuugcauaaggggaucuaauaguaguuucuuuaguagauuaaauugguugacccacuuaaacuucaaauacccagcauugaaugugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaaccagaggcauauuuggcgcaauagcggguuucauagaaaaugguugggagggaaugguggaugguugguacgguuucaggcaucaaaauucugaaggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41001 - RNA, 1701 nt, Artificial Sequence
  hemagglutinin__InfluenzaA__AGW00757
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaagucacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggggucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauuuaaacaggaucacauacggggccugucccagauauguuaagcaaagcacucugaaauuggcaacaggaaugcgaaauguaccagagaaacaaaccagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41002 - RNA, 1701 nt, Artificial Sequence
  hemagglutinin__InfluenzaA__AGW00769
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguagcuucuuuaguagauuaaauugguugacccacuuaaacuucaaguacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugagaaagaauucucagaaguagaagggagaauucaggaccuugagaaauauguugaggacacaaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41003 - RNA, 1701 nt, Artificial Sequence
  hemagglutinin__InfluenzaA__AGW00781
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccgggcacggacaaggaccaaaucuuccuguaugcucaaucaucaggaagaaucacaguaucuaccaaaagaagccaacaagcuguaaucccgaauauugggucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41004 - RNA, 1701 nt, Artificial Sequence; identical to SEQ ID NO: 40986
  hemagglutinin__InfluenzaA__AGW00793

SEQ ID NO: 41005 - RNA, 1701 nt, Artificial Sequence
  hemagglutinin__InfluenzaA__AGW00805
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugagcaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaaaucugaauguaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaauuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41006 - RNA, 1701 nt, Artificial Sequence; identical to SEQ ID NO: 40592
  hemagglutinin__InfluenzaA__AGW00817

SEQ ID NO: 41007 - RNA, 1701 nt, Artificial Sequence; identical to SEQ ID NO: 40985
  hemagglutinin__InfluenzaA__AGW00829

SEQ ID NO: 41008 - RNA, 1701 nt, Artificial Sequence
  hemagglutinin__InfluenzaA__AGW00841
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaauggccgaauugaagucacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggggucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaaccagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41009 - RNA, 1701 nt, Artificial Sequence
  hemagglutinin__InfluenzaA__AGW00853
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaccaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaguugagcuuaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41010 - RNA, 1701 nt, Artificial Sequence; identical to SEQ ID NO: 40371
  hemagglutinin__InfluenzaA__AGW00865

SEQ ID NO: 41011 - RNA, 1701 nt, Artificial Sequence
  hemagglutinin__InfluenzaA__AGW00877
augaagaccaucauugcuuugagcuacauucuaugucuaguuuucgcucaagaacuuccuggaaaugacgacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggauuuagacccagaguaaggaauaucccuagcagaguaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauauggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaggggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41012 - RNA, 1701 nt, Artificial Sequence
  hemagglutinin__InfluenzaA__AGW00889
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauagggucaauaagaaauggaacuuaugaccacaauguguacagggaugaagcauuaaacaaccgguuccagaucaaaggaguugagcugaagucaggguacaaagauuggguccuauggauuuccuuugccauaucauguuuuuugcuuuguguugcuuuguugggguucaucaugugggccugccaaaagggcaacauuaggugcaacauuugcauuuga

SEQ ID NO: 41013 - RNA, 1701 nt, Artificial Sequence; identical to SEQ ID NO: 40371
  hemagglutinin__InfluenzaA__AGW00901

SEQ ID NO: 41014 - RNA, 1701 nt, Artificial Sequence; identical to SEQ ID NO: 40988
  hemagglutinin__InfluenzaA__AGW00913

SEQ ID NO: 41015 - RNA, 1701 nt, Artificial Sequence
  hemagglutinin__InfluenzaA__AGW00931
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaagcucugcuugcauaaggggaucuaauaguaguuucuuuaguagauuaaauugguugacccacuuaaacuucaaauacccagcauugaacgugacuaugccaaacaaugagcaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaaaucugaauguaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcuaaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41016 - RNA, 1701 nt, Artificial Sequence
  hemagglutinin__InfluenzaA__AGW01244
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacaaaugaccgaauugaagucacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggggucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuucuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaaccagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41017 - RNA, 1701 nt, Artificial Sequence; identical to SEQ ID NO: 40984
  hemagglutinin__InfluenzaA__AGW01256

SEQ ID NO: 41018 - RNA, 1701 nt, Artificial Sequence
  hemagglutinin__InfluenzaA__AGW01295
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauuaggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagauucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaguugagcuuaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41019 - RNA, 1701 nt, Artificial Sequence; identical to SEQ ID NO: 40371
  hemagglutinin__InfluenzaA__AGW01307

SEQ ID NO: 41020 - RNA, 1701 nt, Artificial Sequence
  hemagglutinin__InfluenzaA__AGW01319
augaagaccaucauugcuuugagcuacauucuaugucuaguuuucgcucaagaacuuccuggaaaugacgacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaagacggaacaagcucugcuugcauaagaagaucuaauaauaguuucuuuaguagauugaauugguugacccacuuaaacuucaaauacccagcacugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauaaauugaucgggaaaacuaacgagaaauuccaucagauugaaaaagaauucucagaagucgaagggagaauucaggaccuugagaaauauguugaggacacuaaaauagaucucuggucauacaaugcggagcuucuuguugcccuggagaaccaacacacaauugaucuaacugacucagaaaugaacaaacuguuugaaaaaacaaaaaagcaacugagggaaaaugcugaggauaugggcaaugguuguuucaaaauauaccacaaaugugacaaugccugcauaggaucaaucagaaauggaacuuaugaucacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41021 - RNA, 1701 nt, Artificial Sequence
  hemagglutinin__InfluenzaA__AGW01331
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaaaaagcaacugagggaaaaugcugaggauaugggcaaugguuguuucaaaauauaccacaaaugugacaaugccugcauaggaucaaucagaaauggaacuuaugaacacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41022 - RNA, 1701 nt, Artificial Sequence
  hemagglutinin__InfluenzaA__AGW01343
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaagucacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggggucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaaccagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaaaucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41023 - RNA, 1701 nt, Artificial Sequence
  hemagglutinin__InfluenzaA__AGW01355
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuacugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguagcuucuuuaguagauuaaauugguugacccacuuaaacuucaaguacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaacgacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugagaaagaauucucagaaguagaagggagaauucaggaccuugagaaauauguugaggacacaaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaaaggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41024 - RNA, 1701 nt, Artificial Sequence; identical to SEQ ID NO: 40984
  hemagglutinin__InfluenzaA__AGW01367

SEQ ID NO: 41025 - RNA, 1701 nt, Artificial Sequence
  hemagglutinin__InfluenzaA__AGW01391
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugagcaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaaaucugaauguaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41026 - RNA, 1701 nt, Artificial Sequence
  hemagglutinin__InfluenzaA__AGW01403
augaagacuaucauugcuuugagcuacauucuaugucugauuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuaccccuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuuggggaguucaccacccggguacggacaaggaccaaaucuuccuguaugcucaagcagcaggaagaaucacaguaucuaccaaaagaagccaacaagcuguaauuccgaauaucggauccagacccaggguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaacggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguaugguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugauucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacuauguguacagagaugaagcauuaaacaaccgauuccagaucaagggaguugagcugaagucaggguacaaagauuggauccuauggauuuccuuugccacaucauguuuuuugcuuuguguugcuuuguugggguucaucaugugggccugccaaaaaggcaacauuaggugcaacauuugcauuuga

SEQ ID NO: 41027 - RNA, 1701 nt, Artificial Sequence
  hemagglutinin__InfluenzaA__AGW01415
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaauggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggcuugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41028 - RNA, 1701 nt, Artificial Sequence
  hemagglutinin__InfluenzaA__AGW01427
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauuuucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41029 - RNA, 1701 nt, Artificial Sequence
  hemagglutinin__InfluenzaA__AGW01439
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugcaucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41030 - RNA, 1701 nt, Artificial Sequence
  hemagglutinin__InfluenzaA__AGW01451
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggugcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguuguggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41031 - RNA, 1701 nt, Artificial Sequence
  hemagglutinin__InfluenzaA__AGW01463
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucaucuggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugagcaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaaaucugaauguaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41032 - RNA, 1701 nt, Artificial Sequence; identical to SEQ ID NO: 40981
  hemagglutinin__InfluenzaA__AGW01475

SEQ ID NO: 41033 - RNA, 1701 nt, Artificial Sequence
  hemagglutinin__InfluenzaA__AGW01487
augaagacuaucauugcuuugagcuacauucuaugucuaguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacucaaacuucaaauacccagcauugaacgugacuaugccaaacaaugaacaauuugacaaauuguacauuugggggguucaccacccggguacgggcaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggugcaauagcggguuucauagaaaaugguugggagggaaugauggaugguugguacgguuucaggcaccaaaauucugagggaagaggacaagcagcagaucucaaaagcacucaagcagcaaucgaucaaaucaaugggaagcugaaucgauugaucgggaaaaccaacgagaaauuccaucagauugaaaaagaauuuucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41034 - RNA, 1701 nt, Artificial Sequence
  hemagglutinin__InfluenzaA__AGW01499
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugccacugagcugguucagaauuccucaauaggugaaauaugcgacaguccucaucagauccuugauggagaaaacugcacacuaauagaugcucuauugggagacccucagugcgauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcggaauguaccagagaaacaaacuagaggcauauuuggugcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaagaccuugagaaauauguugaggacacuaaaauagaucucuggucauacaacgcggagcuucuuguugcccuagagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggcaugccaaaagggcaacauuaggugcaacauuugcauuuga

SEQ ID NO: 41035 - RNA, 1701 nt, Artificial Sequence
  hemagglutinin__InfluenzaA__AGW01511
augaagacuaucauugcuuugagcuacauucuaugucugguuuucgcucaaaaacuuccuggaaaugacaauagcacggcaacgcugugccuuggacaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuucagaucaagggaguugagcugaagucaggguacaaagauuggauccuauggauuuccuuugccauaucauguuuuuugcucugugcugcuuuguugggguucaucaugugggccugccaaaagggcaacauuaggugcaacauuugcauuuga

SEQ ID NO: 41036 - RNA, 1701 nt, Artificial Sequence
  hemagglutinin__InfluenzaA__AGW01535
augaagacuaucauugcuuugagcuacauucuaugucugguuuucgcucaaaaacuuccuggaaaugacaauagcacggcaacgcugugccuugggcaccaugcagugccaaacggaacgauagugaaaacaaucacaaaugaccgaauugaagucacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaagaaagcuucaauugggcuggggucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaaccagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41037 - RNA, 1701 nt, Artificial Sequence; identical to SEQ ID NO: 40371
  hemagglutinin__InfluenzaA__AGW01547

SEQ ID NO: 41038 - RNA, 1701 nt, Artificial Sequence; identical to SEQ ID NO: 40551
  hemagglutinin__InfluenzaA__AGW01559

SEQ ID NO: 41039 - RNA, 1701 nt, Artificial Sequence; identical to SEQ ID NO: 40981
  hemagglutinin__InfluenzaA__AGW01571

SEQ ID NO: 41040 - RNA, 1701 nt, Artificial Sequence; identical to SEQ ID NO: 40981
  hemagglutinin__InfluenzaA__AGW01583

SEQ ID NO: 41041 - RNA, 1701 nt, Artificial Sequence
  hemagglutinin__InfluenzaA__AGW01595
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaagucacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggggucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaaccagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuccuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41042 - RNA, 1701 nt, Artificial Sequence
  hemagglutinin__InfluenzaA__AGW01607
augaagacuaucauugcuuugagcuacauucuaugucugguucucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuucguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugagcaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaaaucugaauguaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41043 - RNA, 1701 nt, Artificial Sequence
  hemagglutinin__InfluenzaA__AGW01619
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccaaauugaaguuacuaaugcuacugagcuaguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaguacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugagaaagaauucucagaaguagaagggagaauucaggaccuugagaaauauguugaggacacaaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41044 - RNA, 1701 nt, Artificial Sequence; identical to SEQ ID NO: 40981
  hemagglutinin__InfluenzaA__AGW01631

SEQ ID NO: 41045 - RNA, 1701 nt, Artificial Sequence
  hemagglutinin__InfluenzaA__AGW01643
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41046 - RNA, 1701 nt, Artificial Sequence
  hemagglutinin__InfluenzaA__AGW01655
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugagcaauuugacaaauuguacauuugggggguccaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagagguuacuucaaaauacgaagugggaaaagcucaauaaugagaucagaugcacccauuggcaaaugcaaaucugaauguaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41047 - RNA, 1701 nt, Artificial Sequence
  hemagglutinin__InfluenzaA__AGW01667
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaagucacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggggucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaaccagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaaugaaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41048 - RNA, 1701 nt, Artificial Sequence; identical to SEQ ID NO: 40981
  hemagglutinin__InfluenzaA__AGW01679

SEQ ID NO: 41049 - RNA, 1701 nt, Artificial Sequence
  hemagglutinin__InfluenzaA__AGW01691
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauagugaaaccgggagacauacuuuugauuaacagcacaggaaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaaggaagaggacaagcagcagaucucaaaagcacucaagcagcaaucgaucaaaucaaugggaagcugaaucgguugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccauaaaugugacaaugccugcauaggaucaaucagaaauggaacuuaugaccacgauguguacagggaugaagcauuaaacaaccgguuccagaucaagggaguugagcugaagucaggguacaaagacuggauccuauggauuuccuuugccauaucauguuuuuugcuuuguguugcuuuguugggguucgucaugugggccugccaaaagggcaacauuaggugcaacauuugcauuuga

SEQ ID NO: 41050 - RNA, 1701 nt, Artificial Sequence
  hemagglutinin__InfluenzaA__AGW01701
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaauggcugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaguugagcuuaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41051 - RNA, 1701 nt, Artificial Sequence; identical to SEQ ID NO: 40371
  hemagglutinin__InfluenzaA__AGW01713

SEQ ID NO: 41052 - RNA, 1701 nt, Artificial Sequence
  hemagglutinin__InfluenzaA__AGW01725
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaguugagcuuaagucaggguacaaagauuggauccuauggauuuccuuugccauaucauguuuuuugauuuguguugcuuuguugggguucaucaugugggccugccaaaagggcaacauuaggugcaacauuugcauuuga

SEQ ID NO: 41053 - RNA, 1701 nt, Artificial Sequence; identical to SEQ ID NO: 40362
  hemagglutinin__InfluenzaA__AGW01737

SEQ ID NO: 41054 - RNA, 1701 nt, Artificial Sequence
  hemagglutinin__InfluenzaA__AGW01749
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccaucggcaaaugcaagucugaaugcaucacuccaaauggaagcauucccaaugacaaaccauuccaaaauguaaacaggaucacauacggggccugucccagauauguuaagcaaagcacucugaaguuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41055 - RNA, 1701 nt, Artificial Sequence
  hemagglutinin__InfluenzaA__AGW01761
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaagucacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaaguuucaauugggcuggggucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaaccagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaagauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41056 - RNA, 1701 nt, Artificial Sequence
  hemagglutinin__InfluenzaA__AGW01773
augaagacuaucauugcuuugagcuacauucuaugucugguuuucgcucaaaaacuuccuggaaaugacaauagcacugcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggugccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaguugagcuuaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41057 - RNA, 1701 nt, Artificial Sequence; identical to SEQ ID NO: 40551
  hemagglutinin__InfluenzaA__AGW01785

SEQ ID NO: 41058 - RNA, 1701 nt, Artificial Sequence; identical to SEQ ID NO: 40371
  hemagglutinin__InfluenzaA__AGW01797

SEQ ID NO: 41059 - RNA, 1701 nt, Artificial Sequence; identical to SEQ ID NO: 40551
  hemagglutinin__InfluenzaA__AGW01809

SEQ ID NO: 41060 - RNA, 1701 nt, Artificial Sequence
  hemagglutinin__InfluenzaA__AGW01821
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugagcaauuugacaaauuguacauuugggggguccaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaaaucugaauguaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggaucuuauggauuuccuuugccauaucauguuuuuugcuuuguguugcuuuguugggguucaucaugugggccugccaaaagggcaacauuaggugcaacauuugcauuuga

SEQ ID NO: 41061 - RNA, 1701 nt, Artificial Sequence
  hemagglutinin__InfluenzaA__AGW01833
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucagaauaagaaaugggaccuuuuuguugaacggagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauaagaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41062 - RNA, 1701 nt, Artificial Sequence
  hemagglutinin__InfluenzaA__AGW01845
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaccaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaguugagcuuaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41063 - RNA, 1701 nt, Artificial Sequence
  hemagglutinin__InfluenzaA__AGW01857
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccaucggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41064 - RNA, 1701 nt, Artificial Sequence
  hemagglutinin__InfluenzaA__AGW01869
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaagucacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggggucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaaccagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaagauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41065 - RNA, 1701 nt, Artificial Sequence; identical to SEQ ID NO: 41049
  hemagglutinin__InfluenzaA__AGW01881

SEQ ID NO: 41066 - RNA, 1701 nt, Artificial Sequence; identical to SEQ ID NO: 40372
  hemagglutinin__InfluenzaA__AGW01893

SEQ ID NO: 41067 - RNA, 1701 nt, Artificial Sequence; identical to SEQ ID NO: 41003
  hemagglutinin__InfluenzaA__AGW01905

SEQ ID NO: 41068 - RNA, 1701 nt, Artificial Sequence; identical to SEQ ID NO: 40981
  hemagglutinin__InfluenzaA__AGW01917

SEQ ID NO: 41069 - RNA, 1701 nt, Artificial Sequence; identical to SEQ ID NO: 40362
  hemagglutinin__InfluenzaA__AGW01929

SEQ ID NO: 41070 - RNA, 1701 nt, Artificial Sequence; identical to SEQ ID NO: 40981
  hemagglutinin__InfluenzaA__AGW01941

SEQ ID NO: 41071 - RNA, 1701 nt, Artificial Sequence; identical to SEQ ID NO: 40362
  hemagglutinin__InfluenzaA__AGW01953

SEQ ID NO: 41072 - RNA, 1701 nt, Artificial Sequence
  hemagglutinin__InfluenzaA__AGW01965
augaagaccaucauugcuuugagcuacauucuaugucuaguuuucgcucaagaacuuccuggaaaugaugacagcauggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucauuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaaguggaaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugacugcauaggaucaaucagaaauggaacuuaugaucacaauguguacagagaugaagcauuaaacaaccgauuccagaucaagggaauugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41073 - RNA, 1701 nt, Artificial Sequence
  hemagglutinin__InfluenzaA__AGW01977
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaagaggaucuaauaguaguuucuuuaguagauuaaauugguugacccacuuaaacuucaaauacccagcauugaacgugacuaugccaaacaaugagcaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaaaucugaauguaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41074 - RNA, 1701 nt, Artificial Sequence; identical to SEQ ID NO: 40981
  hemagglutinin__InfluenzaA__AGW01989

SEQ ID NO: 41075 - RNA, 1701 nt, Artificial Sequence
  hemagglutinin__InfluenzaA__AGW02001
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaaccagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauauggguaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41076 - RNA, 1701 nt, Artificial Sequence; identical to SEQ ID NO: 40981
  hemagglutinin__InfluenzaA__AGW02013

SEQ ID NO: 41077 - RNA, 1701 nt, Artificial Sequence
  hemagglutinin__InfluenzaA__AGW02025
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggagaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaguugagcuuaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41078 - RNA, 1701 nt, Artificial Sequence
  hemagglutinin__InfluenzaA__AGW02037
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaagucacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggggucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaaccagaggcauauuuggcgcaauagcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaucacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41079 - RNA, 1701 nt, Artificial Sequence; identical to SEQ ID NO: 40547
  hemagglutinin__InfluenzaA__AGW02061

SEQ ID NO: 41080 - RNA, 1701 nt, Artificial Sequence; identical to SEQ ID NO: 40981
  hemagglutinin__InfluenzaA__AGW02073

SEQ ID NO: 41081 - RNA, 1701 nt, Artificial Sequence
  hemagglutinin__InfluenzaA__AGW02085
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaagucacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggggucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaaccagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuauuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41082 - RNA, 1701 nt, Artificial Sequence
  hemagglutinin__InfluenzaA__AGW02097
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuauaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41083 - RNA, 1701 nt, Artificial Sequence
  hemagglutinin__InfluenzaA__AGW02109
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagagguauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaguugagcuuaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41084 - RNA, 1701 nt, Artificial Sequence; identical to SEQ ID NO: 40551
  hemagglutinin__InfluenzaA__AGW02133

SEQ ID NO: 41085 - RNA, 1701 nt, Artificial Sequence; identical to SEQ ID NO: 41073
  hemagglutinin__InfluenzaA__AGW02157

SEQ ID NO: 41086 - RNA, 1701 nt, Artificial Sequence
  hemagglutinin__InfluenzaA__AGW02169
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuacuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaaugugaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauuuucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41087 - RNA, 1701 nt, Artificial Sequence
  hemagglutinin__InfluenzaA__AGW02181
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagguauguuaagcaaagcacucugaaauuggcaacaggaaugcgaaauguaccagagaaacaaaccagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauauggguaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41088 - RNA, 1701 nt, Artificial Sequence; identical to SEQ ID NO: 40372
  hemagglutinin__InfluenzaA__AGW02193

SEQ ID NO: 41089 - RNA, 1701 nt, Artificial Sequence
  hemagglutinin__InfluenzaA__AGW04171
augaagaccaucauugcuuugagcuacauucuaugucuaguuuuugcucaagaacuuccuggaaaugacgacagcacggcaacgcugugccuugggcaccaugcagugccaaacggaacaauagugaaaacaaucacgaaugaccaaauugaaguuacuaaugcuacugaacugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41090 - RNA, 1707 nt, Artificial Sequence
  hemagglutinin__InfluenzaA__AGW27061
auggagaaaauagugcuucuuuuugcaauagucaaccuuguuaaaagcgaccauauuugcauugguuaccaugcaaacaacucgacagagcagguugacacaauaauggaaaagaacguuacuguuacacaugcucaagacauacuggagaagacgcacaaugggaagcucugcgaucuaaauggagugaagccucugauuuuaaaagauuguaguguagcaggauggcuccucgggaacccaaugugugacgaauucaucgaugugccagaauggucuuacauaguagagaaggccaauccagccaaugaccucuguuacccagggaauuucaacgauuaugaagaauuaaaacaccuauugagcagaauaaaccacuucgagaaaauacggaucauucccaaagauucuuggccagaucaugaagccucauugggggugagcgcagcauguucauaccagggaaauuccucauuuuucagaaaugugguauggcuucucaaaaagaacgaugcauacccaauaauaaagaaaagcuacaauaauaccaauaaagaagaucucuugguacuguggggaauccaccauccuaaugaugaagcagagcagauaaggcucuaucaaaacccaaccaccuauguuuccacugggacaucaacacuaaaccagagauugguaccaagaauagcuacuagauccaaaguaaacgggcaaaguggaaggauagacuucuucuggacaauuuuaaaaccgaaugaugcaaucaacuucgagaguaauggaaauuucauugcuccagaauaugcauacaaaauugucaagaaaggagacucaacaauuaugaggagugaaguggaauaugguaacugcagcaccaggugucagacuccgaugggggcgauaaauucuaguaugccauuccacaacauacacccucucaccaucggagaaugucccaaauaugugaaaucaaacaaauuaguccuugcgacugggcucagaaauaguccucaaauagagaggagaagaagaaaaaggggacuguuuggagcuauagcagguuuuauagagggaggauggcagggaaugguagaugguugguauggguaccaucacagcaaugagcaggggaguggguaugcugcagacaaagaauccacucaaaaggcaauagauggggucaccaauaaagucaacucgaucauugacaaaaugaacacucaguuugaggcaguaggaagggaauuuaauaacuuagagaggaggauagagaauuuaaacaagaaaauggaagacggauuccuagaugucuggacuuauaaugcugaacuccugguucuaauggaaaaugagagaacucuagacuuccaugacucaaaugucaagaaccuuuacgacaaggucagacuacagcuuagggauaaugcaaaagagcugggcaacgguuguuucgaguucuaucacaaaugugauaaugaauguauggaaaguguaagaaacggaacguaugacuacccgcaguacucagaagaagcaagauuaaaaagagaggaaauaaguggaguaaaauuggaaucgauaggaacuuaccaaauacugucaauuuauucaacaguggcgaguucccuaguacugucaaucaugguggcuggucuaucuuuauggauguguuccaacgguucguuacaaugcagaaugugcauuuaa

SEQ ID NO: 41091 - RNA, 1698 nt, Artificial Sequence
  hemagglutinin__InfluenzaA__AGY14471
augaaaguaaaacuacugauccuguuauguacauuuacagcuacauaugcagacacaauauguauaggcuaccaugccaacaacucaacugacacuguugacacaauacuugaaaagaaugugacagugacacacucugucaacuuacuugaggacagccacaauggaaaacuaugucuacuaaaaggaauagccccccuacaauuggguaauugcagcguugccggauggaucuuaggaaauccagagugcggauuacugauucccaaggaaucaugguccuacauuguagagacaccaaauccugagaauggaacauguuacccaggauauuuugacgacuaugaggagcuaagagagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaauggucuguacccaaaccugagcaaguccuaugcaaacaacaaagagaaagaaguccucauacuaugggguguucaucacccgucaaacauagggaaccaaaggacucucuaucauacagaaaauacuuaugucucuguagugucuucacauuacagcagaagauucaccccagaaauaaccaaaaggcccaaaguaagagaucaggaaggaagaaucaacuauuacuggacucugcuggaacccggggauacaauaauauuugaggcaaauggaaaucuaauagcgccaugguaugcuuucgcacugaguaaagguuuuggaucaggaaucaucaccucaaaugcaccaauggaugaaugugaugcgaaaugucaaacaccucagggagcuauaaacagcaaucuuccuuuccagaauguacacccagucacaauaggagaguguccaaaguauguuaggaguacaaaauuaaggaugguuacagggcuaaggaacaucccguccauucaauccagagguuuguuuggagccauugccgguuucauugaaggaggauggacuggaaugguagaugggugguacgguuaucaucaucagaaugagcaaggaucuggcuaugcugcagaucaagaaagcacacaaaacgccauuaacgggauuacaaacaaggugaauucuguaauugagaaaaugaacacucaauucacaguugugggcaaagaauucaacaaauuggaaagaagaauggaaaacuuaaauaaaaaagucgaugauggauuucuagacauuuggacauauaaugcagaguuguugguucuacuggaaaaugaaaggacuuuggauuuccacgacuccaaugugaugaauuuguaugagaaaguaaaaggccaauuaaagaauaaugccaaagaaauaggaaauggguguuuugaauucuaucacaaguguaacaacgaaugcauggagagugugaaaaauggaacuuaugacuauccaaaauauuccgaagaaucaaaguuaaacagggaaaaaauugauggagugaaauuggagucaaugggagucuaucagauucuggcgaucuauucaacugucgcuaguucccugguucuuuuagucucccugggggcaaucagcuucuggauguguuccaaugggucuuugcaguguagaauaugcaucuga

SEQ ID NO: 41092 - RNA, 1698 nt, Artificial Sequence
  hemagglutinin__InfluenzaA__AGY14477
augaaaguaaaacuacugauccuguuauguacauuuacagcuacauaugcagacacaauauguauaggcuaccaugccaacaacucaacugacacuguugacacaauacuugaaaagaaugugacagugacacacucugucaacuuacuugaggacagccacaauggaaaacuauguuuacuaaaaggaauagccccccuacaauuggguaauugcagcguugccggauggaucuuaggaaauccagagugcggauuacugauucccaaggaaucaugguccuacauuguagagacaccaaauccugagaauggaacauguuacccaggauauuuugacgacuaugaggagcuaagagagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaauggucuguacccaaaccugagcaaguccuaugcaaacaacaaagagaaagaaguccucauacuaugggguguucaucacccgucaaacauagggaaccaaaggacucucuaucauacagaaaauacuuaugucucuguagugucuucacauuacagcagaagauucaccccagaaauaaccaaaaggcccaaaguaagagaucaggaaggaagaaucaacuauuacuggacucugcuggaacccggggauacaauaauauuugaggcaaauggaaaucuaauagcgccaugguaugcuuucgcacugaguaaagguuuuggaucaggaaucaucaccucaaaugcaccaauggaugaaugugaugcgaaaugucaaacaccucagggagcuauaaacagcaaucuuccuuuccagaauguacacccagucacaauaggagaguguccaaaguauguuaggaguacaaaauuaaggaugguuacagggcuaaggaacaucccguccauucaauccagagguuuguuuggagccauugccgguuucauugaaggaggauggacuggaaugguagaugggugguacgguuaucaucaucagaaugagcaaggaucuggcuaugcugcagaucaagaaagcacacaaaacgccauuaacgggauuacaaacaaggugaauucuguaauugagaaaaugaacacucaauucacaguugugggcaaagaauucaacaaauuggaaagaagaauggaaaacuuaaauaaaaaagucgaugauggauuucuagacauuuggacauauaaugcagaguuguugguucuacuggaaaaugaaaggacuuuggauuuccacgacuccaaugugaugaauuuguaugagaaaguaaaaggccaauuaaagaauaaugccaaagaaauaggaaauggguguuuugaauucuaucacaaguguaacaacgaaugcauggagagugugaaaaauggaacuuaugacuauccaaaauauuccgaagaaucaaaguuaaacagggaaaaaauugauggagugaaauuggagucaaugggagucuaucagauucuggcgaucuauucaacugucgcuaguucccugguucuuuuagucucccugggggcaaucagcuucuggauguguuccaaugggucuuugcaguguagaauaugcaucuga

SEQ ID NO: 41093 - RNA, 1701 nt, Artificial Sequence
  hemagglutinin__InfluenzaA__AHC57459
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuaccccuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaauaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucaaauugaaaaagaauucucagaagucgaagggagaauucaggaccuugagaaauauguugaggacacuaaaauagaucucuggucauacaacgcggagcuucuuguugcccuggagaaccaacacacaauugaucuaacugauucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41094 - RNA, 1701 nt, Artificial Sequence
  hemagglutinin__InfluenzaA__AHC57465
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41095 - RNA, 1701 nt, Artificial Sequence
  hemagglutinin__InfluenzaA__AHC57487
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaucacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41096 - RNA, 1701 nt, Artificial Sequence; identical to SEQ ID NO: 38756
  hemagglutinin__InfluenzaA__AHC57499

SEQ ID NO: 41097 - RNA, 1701 nt, Artificial Sequence
  hemagglutinin__InfluenzaA__AHC57511
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucggaaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41098 - RNA, 1701 nt, Artificial Sequence
  hemagglutinin__InfluenzaA__AHC57523
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccagguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41099 - RNA, 1701 nt, Artificial Sequence
  hemagglutinin__InfluenzaA__AHC57675
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaauggcugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaucacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41100 - RNA, 1701 nt, Artificial Sequence
  hemagglutinin__InfluenzaA__AHC57827
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41101 - RNA, 1701 nt, Artificial Sequence
  hemagglutinin__InfluenzaA__AHC57956
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguuaacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggcuugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41102 - RNA, 1701 nt, Artificial Sequence
  hemagglutinin__InfluenzaA__AHC57981
augaagacuaucauugcuuugagcuacauucuaugucugguuuucgcucaaaaaauuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaauugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaaucugaauagauugaucggaaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41103 - RNA, 1701 nt, Artificial Sequence
  hemagglutinin__InfluenzaA__AHC57993
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41104 - RNA, 1701 nt, Artificial Sequence; identical to SEQ ID NO: 39928
  hemagglutinin__InfluenzaA__AHC58005

SEQ ID NO: 41105 - RNA, 1701 nt, Artificial Sequence
  hemagglutinin__InfluenzaA__AHC58017
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaguaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41106 - RNA, 1701 nt, Artificial Sequence
  hemagglutinin__InfluenzaA__AHC58029
augaagacuaucauugcuuugagcuacauucuaugucugguuuucgcucaaaaacuuccugggaaugacaacagcacggcaacgcugugccuugggcaccaugcagugccaaacggaacgauagugaaaacaaucacgaaugaccaaauugaaguuacuaaugcuacugaacugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggggaucuaauaauaguuucuuuaguagauugaauugguugacccaauuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41107 - RNA, 1701 nt, Artificial Sequence
  hemagglutinin__InfluenzaA__AHC58050
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccagaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41108 - RNA, 1701 nt, Artificial Sequence; identical to SEQ ID NO: 38756
  hemagglutinin__InfluenzaA__AHC58074

SEQ ID NO: 41109 - RNA, 1701 nt, Artificial Sequence; identical to SEQ ID NO: 38756
  hemagglutinin__InfluenzaA__AHC58098

SEQ ID NO: 41110 - RNA, 1701 nt, Artificial Sequence
  hemagglutinin__InfluenzaA__AHC58110
augaagacuaucauugcuuugagcuacauucuaugucugguuuucgcucaaaaacuuccuggaaaugacaacagcacggcaacgcugugccuugggcaccaugcaguaccaaacggaacaauagugaaaacaaucacgaaugaccaaauugaaguuacuaaugcuacugagcugguucagaauuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41111 - RNA, 1701 nt, Artificial Sequence; identical to SEQ ID NO: 41097
  hemagglutinin__InfluenzaA__AHC58126

SEQ ID NO: 41112 - RNA, 1701 nt, Artificial Sequence
  hemagglutinin__InfluenzaA__AHC58138
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauucgacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41113 - RNA, 1701 nt, Artificial Sequence; identical to SEQ ID NO: 38756
  hemagglutinin__InfluenzaA__AHC58162

SEQ ID NO: 41114 - RNA, 1701 nt, Artificial Sequence
  hemagglutinin__InfluenzaA__AHC58186
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41115 - RNA, 1701 nt, Artificial Sequence
  hemagglutinin__InfluenzaA__AHC58198
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacagcccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucagaaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggacugccaaaaaggcaacauuaggugcaacauuugcauuuga

SEQ ID NO: 41116 - RNA, 1701 nt, Artificial Sequence
  hemagglutinin__InfluenzaA__AHC58210
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaacgguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41117 - RNA, 1701 nt, Artificial Sequence; identical to SEQ ID NO: 41100
  hemagglutinin__InfluenzaA__AHC58234

SEQ ID NO: 41118 - RNA, 1701 nt, Artificial Sequence; identical to SEQ ID NO: 41097
  hemagglutinin__InfluenzaA__AHC58246

SEQ ID NO: 41119 - RNA, 1701 nt, Artificial Sequence
  hemagglutinin__InfluenzaA__AHC58258
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuaccaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaauggcugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaucacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41120 - RNA, 1701 nt, Artificial Sequence
  hemagglutinin__InfluenzaA__AHC58270
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauucuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41121 - RNA, 1701 nt, Artificial Sequence
  hemagglutinin__InfluenzaA__AHC58372
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucuucaggaagaaucacaguaucuaccaaaagaagccaacaagcuguaaccccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaaugggagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacgaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41122 - RNA, 1701 nt, Artificial Sequence
  hemagglutinin__InfluenzaA__AHC58396
augaagacuaucauugcuuugagcuacauucuaugucugguuuucgcucaaaaacuuccugggaaugacaacagcacggcaacgcugugccuugggcaccaugcagugccaaacggaacgauagugaaaacaaucacgaaugaccaaauugaaguuacuaaugcuacugaacugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggggaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucaccccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41123 - RNA, 1701 nt, Artificial Sequence; identical to SEQ ID NO: 38756
  hemagglutinin__InfluenzaA__AHC58408

SEQ ID NO: 41124 - RNA, 1701 nt, Artificial Sequence
  hemagglutinin__InfluenzaA__AHC58420
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguaugguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41125 - RNA, 1701 nt, Artificial Sequence; identical to SEQ ID NO: 41124
  hemagglutinin__InfluenzaA__AHC58432

SEQ ID NO: 41126 - RNA, 1701 nt, Artificial Sequence
  hemagglutinin__InfluenzaA__AHC58444
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuuggggaguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaauggcugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaucacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41127 - RNA, 1701 nt, Artificial Sequence; identical to SEQ ID NO: 41122
  hemagglutinin__InfluenzaA__AHC58456

SEQ ID NO: 41128 - RNA, 1701 nt, Artificial Sequence
  hemagglutinin__InfluenzaA__AHC58468
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaggacaagcauaacgggaaacuaugcaaacugagagggguagccccauugcauuuggguaaauguaacauugcuggcuggauccugggaaauccagagugugaaucacucuccacagcaagcucaugguccuacaucguggaaacaucuaguucagacaauggaacgugcuacccaggagauuucaucaauuaugaggagcuaagagagcaauugagcucagugucaucauuugaaagguuugagauauucccuaagacaaguucauggcccaaucaugacucgaacaaaggugugacggcagcauguccucaagcuggagcaaaaagcuucuacaaaaauuuaauauggcuaguuaaaaaagggaauucauacccaaagcucagcaaauccuacauuaacgauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaguaagacccaaagugagggaucaagaagggagaaugaacuauuacuggacacuaguagagccgggagacaaaauaacauucgaagcaacuggaaaucuauugguaccaagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaaugucccaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugcgcaggggucaggauaugcagccgaccugaagagcacacagaaugccauugacaagauuacuaacaaaguaaauucuguuauugaaaagaugaauacacaguucacagcaguagguaaagaguucaaccaccuggaaagaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuaccccaaauacucagaggaagcaaaauuaaacagagaggaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 41129 - RNA, 1701 nt, Artificial Sequence
  hemagglutinin__InfluenzaA__AHC58479
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagaucauugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaguuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucaaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguucaagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41130 - RNA, 1701 nt, Artificial Sequence
  hemagglutinin__InfluenzaA__AHC58491
augaagacuaucauugcuuugagcuacauucuaugucugguuuucgcucaaaaacuuccugggaaugacaacagcacggcaacgcugugccuugggcaccaugcagugccaaacggaacgauagugaaaacaaucacgaaugaccaaauugaaguuacuaaugcuacugaacugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggggaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41131 - RNA, 1701 nt, Artificial Sequence
  hemagglutinin__InfluenzaA__AHC58515
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuugucgaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcauuuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaauggcugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaucacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41132 - RNA, 1701 nt, Artificial Sequence; identical to SEQ ID NO: 38756
  hemagglutinin__InfluenzaA__AHC58527

SEQ ID NO: 41133 - RNA, 1701 nt, Artificial Sequence
  hemagglutinin__InfluenzaA__AHC58563
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagaucauugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaguuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41134 - RNA, 1701 nt, Artificial Sequence
  hemagglutinin__InfluenzaA__AHC58575
augaagacuaucauugcuuugagcuacauucuaugucugguuuucgcucaaaaacuuccuggaaaugacaacagcacggcaacgcugugccuugggcaccaugcaguaccaaacggaacaauagugaaaacaaucacgaaugaccaaauugaaguuacuaaugcuacugagcugguucagaauuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuagaucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcuaaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41135 - RNA, 1701 nt, Artificial Sequence; identical to SEQ ID NO: 41095
  hemagglutinin__InfluenzaA__AHC58587

SEQ ID NO: 41136 - RNA, 1701 nt, Artificial Sequence; identical to SEQ ID NO: 41099
  hemagglutinin__InfluenzaA__AHC58599

SEQ ID NO: 41137 - RNA, 1701 nt, Artificial Sequence; identical to SEQ ID NO: 41097
  hemagglutinin__InfluenzaA__AHC58611

SEQ ID NO: 41138 - RNA, 1701 nt, Artificial Sequence; identical to SEQ ID NO: 38756
  hemagglutinin__InfluenzaA__AHC58623

SEQ ID NO: 41139 - RNA, 1701 nt, Artificial Sequence; identical to SEQ ID NO: 41098
  hemagglutinin__InfluenzaA__AHC58647

SEQ ID NO: 41140 - RNA, 1701 nt, Artificial Sequence; identical to SEQ ID NO: 41126
  hemagglutinin__InfluenzaA__AHC58659

SEQ ID NO: 41141 - RNA, 1701 nt, Artificial Sequence
  hemagglutinin__InfluenzaA__AHC58671
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaauugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguuaacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41142 - RNA, 1701 nt, Artificial Sequence; identical to SEQ ID NO: 41124
  hemagglutinin__InfluenzaA__AHC58683

SEQ ID NO: 41143 - RNA, 1701 nt, Artificial Sequence
  hemagglutinin__InfluenzaA__AHC58695
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguuaacccacuuaaacuucaaauacccagcauuaaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41144 - RNA, 1701 nt, Artificial Sequence
  hemagglutinin__InfluenzaA__AHC58707
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucaucuggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugaucaacagcacagggaaucugauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcugguuucauagaaaaugguugggagggaaugguggaugguugguacgguuucaggcaucaaaauucugagggaagaggacaagcagcagaucucaaaagcacucaagcagcaauagaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41145 - RNA, 1701 nt, Artificial Sequence
  hemagglutinin__InfluenzaA__AHC58719
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucaucuggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugaucaacagcacagggaaucugauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaauagaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41146 - RNA, 1701 nt, Artificial Sequence
  hemagglutinin__InfluenzaA__AHC58731
augaagacuaucauugcuuugagcuacauucuaugucugguuuucgcucaaaaacuuccugggaaugacaacagcacggcaacgcugugccuugggcaccaugcagugccaaacggaacgauagugaaaacaaucacuaaugaccaaauugaaguuacuaaugcuacugaacugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaaguaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggggaucuaauaauaguuucuuuaguagauugaauugguugacucacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucaccccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41147 - RNA, 1701 nt, Artificial Sequence
  hemagglutinin__InfluenzaA__AHC58743
augaagacuaucauugcuuggagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucggaaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41148 - RNA, 1701 nt, Artificial Sequence; identical to SEQ ID NO: 41130
  hemagglutinin__InfluenzaA__AHC58755

SEQ ID NO: 41149 - RNA, 1701 nt, Artificial Sequence
  hemagglutinin__InfluenzaA__AHC58779
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaagggggcaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41150 - RNA, 1701 nt, Artificial Sequence
  hemagglutinin__InfluenzaA__AHC58791
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucuucaggaagaaucacaguaucuaccaaaagaagccaacaagcuguaaccccgaauaucggaucuagacccagaauaaggaacaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaaugggagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41151 - RNA, 1701 nt, Artificial Sequence
  hemagglutinin__InfluenzaA__AHC58803
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagaucauugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaguuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugaaaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguucaagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41152 - RNA, 1701 nt, Artificial Sequence
  hemagglutinin__InfluenzaA__AHC58815
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcaacaguccucaucagauccuugauggaggaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacugacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaaguugaauagauugauagggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41153 - RNA, 1701 nt, Artificial Sequence
  hemagglutinin__InfluenzaA__AHC58827
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguuaacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaacgccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41154 - RNA, 1701 nt, Artificial Sequence; identical to SEQ ID NO: 38756
  hemagglutinin__InfluenzaA__AHC58839

SEQ ID NO: 41155 - RNA, 1701 nt, Artificial Sequence
  hemagglutinin__InfluenzaA__AHC58863
augaagacuaucauugcuuugagcuacauucuaugucugguuuucgcucaaaaacuuccugggaaugacaacagcacggcaacgcugugccuugggcaccaugcagugucaaacggaacgauagugaaaacaaucacgaaugaccaaauugaaguuacuaaugcuacugaacugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggggaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugauggaugguugguacgguuucaggcaucaaaacucugagggaaggggacaagcagcagaucucaaaagcacucaagcagcaaucgaucaaaucaaugggaagcugaauagauugaucggaaaaaccaacgagaaauuccaucagauugaaaaagaauucucagaagucgaagggaggauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41156 - RNA, 1701 nt, Artificial Sequence; identical to SEQ ID NO: 41153
  hemagglutinin__InfluenzaA__AHC58875

SEQ ID NO: 41157 - RNA, 1701 nt, Artificial Sequence; identical to SEQ ID NO: 38756
  hemagglutinin__InfluenzaA__AHC58887

SEQ ID NO: 41158 - RNA, 1701 nt, Artificial Sequence
  hemagglutinin__InfluenzaA__AHC58899
augaagacuaucauugcuuugagcuacauucuaugucugguuuucgcucaaaaacuuccugggaaugacaacagcacggcaacgcugugccuugggcaccaugcagugccaaacggaacgauagugaaaacaaucacgaaugaccaaauugaaguuacuaaugcuacugaacugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggggaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucgggucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucaccccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaagauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41159 - RNA, 1701 nt, Artificial Sequence; identical to SEQ ID NO: 38756
  hemagglutinin__InfluenzaA__AHC58981

SEQ ID NO: 41160 - RNA, 1701 nt, Artificial Sequence; identical to SEQ ID NO: 38756
  hemagglutinin__InfluenzaA__AHC58993

SEQ ID NO: 41161 - RNA, 1701 nt, Artificial Sequence
  hemagglutinin__InfluenzaA__AHC59005
augaagacuaucauugcuuugagcuacauucuaugucugguuuucgcucaaaaacuuccuggaaaugacaacagcacggcaacgcugugccuugggcaccaugcaguaccaaacggaacaauagugaaaacaaucacgaaugaccaaauugaaguuacuaaugcuacugagcugguucagaauuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaccuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41162 - RNA, 1701 nt, Artificial Sequence
  hemagglutinin__InfluenzaA__AHC59017
augaagacuaucauugcuuugagcuacauucuaugucugguuuucgcucaaaaacuuccugggaaugacaacagcacggcaacgcugugccuugggcaccaugcagugccaaacggaacgauagugaaaacaaucacgaaugaccaaauugaaguuacuaaugcuacugaacugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggggaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcaggguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugagcaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41163 - RNA, 1701 nt, Artificial Sequence
  hemagglutinin__InfluenzaA__AHC59029
augaagacuaucauugcuuugagcuacauucuaugucugguuuucgcucaaaaacuuccugggaaugacaacagcacggcaacgcugugccuugggcaccaugcagugccaaacggaacgauagugaaaacaaucacgaaugaccaaauugaaguuacuaaugcuacugaacugguucagaguuccucaacaggugaaauaugcaacaguccucaucagauucuugauggagaaaacugcacacuaauagaugcucuauugggagacccucagugugauggcuuucaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggggaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucaccccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41164 - RNA, 1701 nt, Artificial Sequence
  hemagglutinin__InfluenzaA__AHC59041
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagauccaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaauggcugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaucacaaaugugacaaugccugcauaggaucaaucagaaauggaaccuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41165 - RNA, 1701 nt, Artificial Sequence
  hemagglutinin__InfluenzaA__AHC59053
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacaaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucauguggaccugccaaaaaggcaacauuaggugcaacauuugcauuuga

SEQ ID NO: 41166 - RNA, 1701 nt, Artificial Sequence
  hemagglutinin__InfluenzaA__AHC59077
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 41167 - RNA, 1701 nt, Artificial Sequence
  hemagglutinin__InfluenzaA__AHC59089
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaagaaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaauagaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41168 - RNA, 1701 nt, Artificial Sequence; identical to SEQ ID NO: 38756
  hemagglutinin__InfluenzaA__AHC59101

SEQ ID NO: 41169 - RNA, 1701 nt, Artificial Sequence; identical to SEQ ID NO: 41100
  hemagglutinin__InfluenzaA__AHC59113

SEQ ID NO: 41170 - RNA, 1701 nt, Artificial Sequence
  hemagglutinin__InfluenzaA__AHC59125
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaacgguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41171 - RNA, 1701 nt, Artificial Sequence
  hemagglutinin__InfluenzaA__AHC59137
augaagacuaucauugcuuugagcuacauucuaugucugguuuucgcucaaaaaauuccugggaaugacaacagcacggcaacgcugugccuugggcaccaugcagugucaaacggaacgauagugaaaacaaucacgaaugaccaaauugaaguuacuaaugcuacugaacugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggggaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugauggaugguugguacgguuucaggcaucaaaacucugagggaaggggacaagcagcagaucucaaaagcacucaagcagcaaucgaucaaaucaaugggaagcugaauagauugaucggaaaaaccaacgagaaauuccaucagauugaaaaagaauucucagaagucgaagggaggauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41172 - RNA, 1701 nt, Artificial Sequence
  hemagglutinin__InfluenzaA__AHC59149
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuaccaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacccaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaauggcugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaucacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41173 - RNA, 1701 nt, Artificial Sequence
  hemagglutinin__InfluenzaA__AHC59185
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguaugguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41174 - RNA, 1701 nt, Artificial Sequence
  hemagglutinin__InfluenzaA__AHC59197
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucaaugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguuaacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41175 - RNA, 1701 nt, Artificial Sequence
  hemagglutinin__InfluenzaA__AHC59209
augaagacuaucauugcuuugagcuacauucuaugucugguuuucgcucaagaaauuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugaugacuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauuaaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaggcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcgaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagagguauauuuggcgcaauagcggguuucauagaaaauggcugggagggaaugguggaugguugguacgguuucaggcaucaaaauucugagggaaggggacaggcagcagaucucaaaagcacucaagcagcaaucgaccaaaucaaugggaagcugaauagauugaucgggaaaaccaaugagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucugacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgcuguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41176 - RNA, 1701 nt, Artificial Sequence; identical to SEQ ID NO: 41100
  hemagglutinin__InfluenzaA__AHC59221

SEQ ID NO: 41177 - RNA, 1701 nt, Artificial Sequence
  hemagglutinin__InfluenzaA__AHC59245
augaagacuaucauugcuuugagcuacauucuaugucugguuuucgcucaaaaacuuccugggaaugacaacagcacggcaacgcugugccuugggcaccaugcagugucaaacggaacgauagugaaaacaaucacgaaugaccaaauugaaguuacuaaugcuacugaacugguucagaguuccucaacaggugaaauaugcaacaguccucaucagauccuugauggagaaaacugcacacuaauagaugcucuauugggagacccucagugugauggcuuccaaaacaagaaaugggaucuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggggaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugauggaugguugguacgguuucaggcaucaaaacucugagggaaggggacaagcagcagaucucaaaagcacucaagcagcaaucgaucaaaucaaugggaagcugaauagauugaucggaaaaaccaacgagaaauuccaucagauugaaaaagaauucucagaagucgaagggaggauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41178 - RNA, 1701 nt, Artificial Sequence; identical to SEQ ID NO: 41122
  hemagglutinin__InfluenzaA__AHC59257

SEQ ID NO: 41179 - RNA, 1701 nt, Artificial Sequence; identical to SEQ ID NO: 38756
  hemagglutinin__InfluenzaA__AHC59269

SEQ ID NO: 41180 - RNA, 1701 nt, Artificial Sequence
  hemagglutinin__InfluenzaA__AHC59281
augaagacuaucauugcuuugagcuacauucuaugucugguuuucgcucaaaaacuuccugggaaugacaacagcacggcaacgcugugccuugggcaccaugcagugccaaacggaacgauagugaaaacaaucacgaaugaccaaauugaaguuacuaaugcuacugaacugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggggaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucaccccaaauggaagcauucccaaugacaaaccauuccaaaauguaaacaggaucacauacggggccugucccagauauguuaagcaaaacacucugaaauuggcaacaggaaugagaaauguaccagagaagcaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaauaaaugggaagcugaauagauugaucgggaaaaccaacgagaaauuccaucagauugaaaaagaauucucagaagucgaagggagaauucaggaccuugagaaauauguugaggacacuaaaauagaucucuggucauacaaugcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41181 - RNA, 1701 nt, Artificial Sequence; identical to SEQ ID NO: 41100
  hemagglutinin__InfluenzaA__AHC59293

SEQ ID NO: 41182 - RNA, 1701 nt, Artificial Sequence
  hemagglutinin__InfluenzaA__AHC59305
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcagcaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaaugugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41183 - RNA, 1701 nt, Artificial Sequence
  hemagglutinin__InfluenzaA__AHC59329
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccggguacggaaaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggcuugccccagauauguuaagcaaagcacucugaaguuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcugcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaacgcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41184 - RNA, 1701 nt, Artificial Sequence; identical to SEQ ID NO: 41124
  hemagglutinin__InfluenzaA__AHC59341

SEQ ID NO: 41185 - RNA, 1701 nt, Artificial Sequence; identical to SEQ ID NO: 41130
  hemagglutinin__InfluenzaA__AHC59365

SEQ ID NO: 41186 - RNA, 1701 nt, Artificial Sequence
  hemagglutinin__InfluenzaA__AHC59377
augaagacuaucauugcuuugagcuacauucuaugucugguuuucgcucaaaaacuuccuggaaaugacaacagcacggcaacgcugugccuugggcaccaugcaguaccaaacggaacgguagugaaaacaaucacgaaugaccaaauugaaguuacuaaugcuacugagcugguucagaauuccucaacaggugaaauaugcgacagcccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucagaaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41187 - RNA, 1701 nt, Artificial Sequence; identical to SEQ ID NO: 41100
  hemagglutinin__InfluenzaA__AHC59413

SEQ ID NO: 41188 - RNA, 1701 nt, Artificial Sequence; identical to SEQ ID NO: 41161
  hemagglutinin__InfluenzaA__AHC59425

SEQ ID NO: 41189 - RNA, 1701 nt, Artificial Sequence
  hemagglutinin__InfluenzaA__AHC59437
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugaucaacagcacagggaaucugauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaauagaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41190 - RNA, 1701 nt, Artificial Sequence
  hemagglutinin__InfluenzaA__AHC59449
augaagacuaucauugcuuugagcuacauucuaugucugguuuucgcucaaaaacuuccugggaaugacaacagcacggcaacgcugugccuugggcaccaugcagugccaaacggaacgauagugaaaacaaucacgaaugaccaaauugaaguuacuaaugcuacugaacugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggggaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucaccccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggagaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagagaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41191 - RNA, 1701 nt, Artificial Sequence; identical to SEQ ID NO: 38861
  hemagglutinin__InfluenzaA__AHC59461

SEQ ID NO: 41192 - RNA, 1701 nt, Artificial Sequence; identical to SEQ ID NO: 41183
  hemagglutinin__InfluenzaA__AHC59473

SEQ ID NO: 41193 - RNA, 1701 nt, Artificial Sequence; identical to SEQ ID NO: 41100
  hemagglutinin__InfluenzaA__AHC59485

SEQ ID NO: 41194 - RNA, 1701 nt, Artificial Sequence
  hemagglutinin__InfluenzaA__AHC59497
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccauccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41195 - RNA, 1701 nt, Artificial Sequence
  hemagglutinin__InfluenzaA__AHC59509
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguuaacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41196 - RNA, 1701 nt, Artificial Sequence; identical to SEQ ID NO: 41195
  hemagglutinin__InfluenzaA__AHC59521

SEQ ID NO: 41197 - RNA, 1701 nt, Artificial Sequence
  hemagglutinin__InfluenzaA__AHC59533
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaaaaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaauggcugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaucacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41198 - RNA, 1701 nt, Artificial Sequence
  hemagglutinin__InfluenzaA__AHC59545
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagacgaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41199 - RNA, 1701 nt, Artificial Sequence; identical to SEQ ID NO: 41122
  hemagglutinin__InfluenzaA__AHC59557

SEQ ID NO: 41200 - RNA, 1701 nt, Artificial Sequence
  hemagglutinin__InfluenzaA__AHC59569
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41201 - RNA, 1701 nt, Artificial Sequence; identical to SEQ ID NO: 41119
  hemagglutinin__InfluenzaA__AHC59581

SEQ ID NO: 41202 - RNA, 1701 nt, Artificial Sequence; identical to SEQ ID NO: 41195
  hemagglutinin__InfluenzaA__AHC59593

SEQ ID NO: 41203 - RNA, 1701 nt, Artificial Sequence
  hemagglutinin__InfluenzaA__AHC59605
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaauagaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41204 - RNA, 1701 nt, Artificial Sequence; identical to SEQ ID NO: 41099
  hemagglutinin__InfluenzaA__AHC59617

SEQ ID NO: 41205 - RNA, 1701 nt, Artificial Sequence; identical to SEQ ID NO: 41198
  hemagglutinin__InfluenzaA__AHC59629

SEQ ID NO: 41206 - RNA, 1701 nt, Artificial Sequence
  hemagglutinin__InfluenzaA__AHC59641
augaagacuaucauugcuuugagcuacauucuaugucugguuuucgcucaaaaacuuccugggaaugacaacagcacggcaacgcugugccuugggcaccaugcagugccaaacggaacgauagugaaaacaaucacgaaugaccaaauugaaguuacuaaugcuacugaacugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggggaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaauaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41207 - RNA, 1701 nt, Artificial Sequence
  hemagglutinin__InfluenzaA__AHC59653
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuacccaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41208 - RNA, 1701 nt, Artificial Sequence; identical to SEQ ID NO: 41195
  hemagglutinin__InfluenzaA__AHC59665

SEQ ID NO: 41209 - RNA, 1701 nt, Artificial Sequence; identical to SEQ ID NO: 41119
  hemagglutinin__InfluenzaA__AHC59677

SEQ ID NO: 41210 - RNA, 1701 nt, Artificial Sequence
  hemagglutinin__InfluenzaA__AHC59689
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuacccaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41211 - RNA, 1701 nt, Artificial Sequence; identical to SEQ ID NO: 41158
  hemagglutinin__InfluenzaA__AHC59701

SEQ ID NO: 41212 - RNA, 1701 nt, Artificial Sequence; identical to SEQ ID NO: 41149
  hemagglutinin__InfluenzaA__AHC59713

SEQ ID NO: 41213 - RNA, 1701 nt, Artificial Sequence
  hemagglutinin__InfluenzaA__AHC59737
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaagucacuaaugcuacugagcugguucagaauuccucaacaggugaaauaugcgacaguccucaucagaucauugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaguuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41214 - RNA, 1701 nt, Artificial Sequence
  hemagglutinin__InfluenzaA__AHC59749
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuagcagauugaauugguuaacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41215 - RNA, 1701 nt, Artificial Sequence
  hemagglutinin__InfluenzaA__AHC59761
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucaaaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaauggcugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauuuucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaucacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41216 - RNA, 1701 nt, Artificial Sequence
  hemagglutinin__InfluenzaA__AHC59773
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucaaaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaauggcugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaucacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41217 - RNA, 1701 nt, Artificial Sequence; identical to SEQ ID NO: 38756
  hemagglutinin__InfluenzaA__AHC59785

SEQ ID NO: 41218 - RNA, 1701 nt, Artificial Sequence; identical to SEQ ID NO: 41119
  hemagglutinin__InfluenzaA__AHC59797

SEQ ID NO: 41219 - RNA, 1701 nt, Artificial Sequence; identical to SEQ ID NO: 41124
  hemagglutinin__InfluenzaA__AHC59809

SEQ ID NO: 41220 - RNA, 1701 nt, Artificial Sequence
  hemagglutinin__InfluenzaA__AHC59821
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauucaucaacaggugaaauaugcgacaguccucaucagauccuugauggagaaaacugcacacuaauagaugcucuauugggagacccucagugugauggccuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaacagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaaucgaucuaacugacucagaaaugaacaaacugguugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41221 - RNA, 1701 nt, Artificial Sequence; identical to SEQ ID NO: 41206
  hemagglutinin__InfluenzaA__AHC59833

SEQ ID NO: 41222 - RNA, 1701 nt, Artificial Sequence
  hemagglutinin__InfluenzaA__AHC59845
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucaaaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucuucaggaagaaucacaguaucuaccaaaagaagccaacaagcuguaaccccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaaugggagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41223 - RNA, 1701 nt, Artificial Sequence; identical to SEQ ID NO: 41097
  hemagglutinin__InfluenzaA__AHC59857

SEQ ID NO: 41224 - RNA, 1701 nt, Artificial Sequence; identical to SEQ ID NO: 41126
  hemagglutinin__InfluenzaA__AHC59869

SEQ ID NO: 41225 - RNA, 1701 nt, Artificial Sequence; identical to SEQ ID NO: 41099
  hemagglutinin__InfluenzaA__AHC59881

SEQ ID NO: 41226 - RNA, 1701 nt, Artificial Sequence; identical to SEQ ID NO: 38861
  hemagglutinin__InfluenzaA__AHC59892

SEQ ID NO: 41227 - RNA, 1701 nt, Artificial Sequence
  hemagglutinin__InfluenzaA__AHC59904
augaagacuaucauugcuuugagcuacauucuaugucugguuuucgcucaaaaacuuccugggaaugacaacagcacggcaacgcugugccuugggcaccaugcagugccaaacggaacgauagugaaaacaaucacgaaugaccaaauugaaguuacuaaugcuacugaacugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggggaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacuuugaaauuggcaacaggaaugagaaauguaccagagaaacaaacuagaggcauauuuggcgcaauagcggguuucauagaaaaugguugggagggaaugauggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaaaggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41228 - RNA, 1701 nt, Artificial Sequence
  hemagglutinin__InfluenzaA__AHC59915
augaagacugucauugcuuugagcuacauucuaugucuggcuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacugacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41229 - RNA, 1701 nt, Artificial Sequence
  hemagglutinin__InfluenzaA__AHC59939
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggaucuuauggauuuccuuugccauaucauguuuuuugcuuuguguugcuuuguugggguucaucaugugggccugccaaaaaggcaacauuaggugcaacauuugcauuuga

SEQ ID NO: 41230 - RNA, 1701 nt, Artificial Sequence
  hemagglutinin__InfluenzaA__AHC59963
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuauuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauauuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaauagaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41231 - RNA, 1701 nt, Artificial Sequence
  hemagglutinin__InfluenzaA__AHC59987
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugacggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucggaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41232 - RNA, 1701 nt, Artificial Sequence; identical to SEQ ID NO: 41195
  hemagglutinin__InfluenzaA__AHC59999

SEQ ID NO: 41233 - RNA, 1701 nt, Artificial Sequence; identical to SEQ ID NO: 41100
  hemagglutinin__InfluenzaA__AHC60011

SEQ ID NO: 41234 - RNA, 1701 nt, Artificial Sequence
  hemagglutinin__InfluenzaA__AHC60023
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaaaaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41235 - RNA, 1701 nt, Artificial Sequence; identical to SEQ ID NO: 38756
  hemagglutinin__InfluenzaA__AHC60035

SEQ ID NO: 41236 - RNA, 1701 nt, Artificial Sequence
  hemagglutinin__InfluenzaA__AHC60047
augaagacuaucauugcuuugagcuacauucuaugucugguuuucgcucaaaaacuuccuggaaaugacaacagcacggcaacgcugugccuugggcaccaugcaguaccaaauggaacgauagugaaaacaaucacgaaugaccaaauugaaguuacuaaugcuacugagcugguucagaauuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41237 - RNA, 1701 nt, Artificial Sequence
  hemagglutinin__InfluenzaA__AHC60059
augaagacuaucauugcuuugagcuacauucuaugucugguuuucgcucaaaaacuuccuggaaaugacaacagcacggcaacgcugugccuugggcaccaugcaguaccaaauggaacgauagugaaaacaaucacgaaugaccaaauugaaguuacuaaugcuacugagcugguucagaauuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41238 - RNA, 1701 nt, Artificial Sequence
  hemagglutinin__InfluenzaA__AHC60071
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucuucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaaugggagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41239 - RNA, 1701 nt, Artificial Sequence; identical to SEQ ID NO: 41122
  hemagglutinin__InfluenzaA__AHC60083

SEQ ID NO: 41240 - RNA, 1701 nt, Artificial Sequence
  hemagglutinin__InfluenzaA__AHC60095
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcaggauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41241 - RNA, 1701 nt, Artificial Sequence
  hemagglutinin__InfluenzaA__AHC60107
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagaucauugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacauuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaguuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguucaagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41242 - RNA, 1701 nt, Artificial Sequence; identical to SEQ ID NO: 41119
  hemagglutinin__InfluenzaA__AHC60119

SEQ ID NO: 41243 - RNA, 1701 nt, Artificial Sequence; identical to SEQ ID NO: 41100
  hemagglutinin__InfluenzaA__AHC60131

SEQ ID NO: 41244 - RNA, 1701 nt, Artificial Sequence; identical to SEQ ID NO: 41152
  hemagglutinin__InfluenzaA__AHC60143

SEQ ID NO: 41245 - RNA, 1701 nt, Artificial Sequence
  hemagglutinin__InfluenzaA__AHC60155
augaagacugucauugcuuugagcuacauucuaugucuggcuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccccaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacugacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41246 - RNA, 1701 nt, Artificial Sequence
  hemagglutinin__InfluenzaA__AHC60167
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaauggaaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41247 - RNA, 1701 nt, Artificial Sequence; identical to SEQ ID NO: 38756
  hemagglutinin__InfluenzaA__AHC60179

SEQ ID NO: 41248 - RNA, 1701 nt, Artificial Sequence; identical to SEQ ID NO: 41197
  hemagglutinin__InfluenzaA__AHC60191

SEQ ID NO: 41249 - RNA, 1701 nt, Artificial Sequence; identical to SEQ ID NO: 41197
  hemagglutinin__InfluenzaA__AHC60203

SEQ ID NO: 41250 - RNA, 1701 nt, Artificial Sequence
  hemagglutinin__InfluenzaA__AHC60215
augaagacuaucauugcuuugagcuacauucuaugucugguuuucgcucaaaaacuuccuggaaaugacaacagcacggcaacgcugugccuugggcaccaugcaguaccaaauggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaauagaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41251 - RNA, 1701 nt, Artificial Sequence; identical to SEQ ID NO: 38756
  hemagglutinin__InfluenzaA__AHC60239

SEQ ID NO: 41252 - RNA, 1701 nt, Artificial Sequence
  hemagglutinin__InfluenzaA__AHC60251
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuugaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41253 - RNA, 1701 nt, Artificial Sequence
  hemagglutinin__InfluenzaA__AHC60263
augaagacuaucauugcuuugagcuacauucuaugucugguuuucgcucaaaaacuuccuggaaaugaaaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcacuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41254 - RNA, 1701 nt, Artificial Sequence; identical to SEQ ID NO: 41195
  hemagglutinin__InfluenzaA__AHC60275

SEQ ID NO: 41255 - RNA, 1701 nt, Artificial Sequence
  hemagglutinin__InfluenzaA__AHC60287
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagaucauugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaguuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguucaagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41256 - RNA, 1701 nt, Artificial Sequence; identical to SEQ ID NO: 41122
  hemagglutinin__InfluenzaA__AHC60299

SEQ ID NO: 41257 - RNA, 1701 nt, Artificial Sequence
  hemagglutinin__InfluenzaA__AHC60311
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuugacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41258 - RNA, 1701 nt, Artificial Sequence; identical to SEQ ID NO: 38756
  hemagglutinin__InfluenzaA__AHC60323

SEQ ID NO: 41259 - RNA, 1701 nt, Artificial Sequence
  hemagglutinin__InfluenzaA__AHC60335
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugaucaacagcacagggaaucugauugcuccuagagguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaauagaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41260 - RNA, 1701 nt, Artificial Sequence; identical to SEQ ID NO: 41231
  hemagglutinin__InfluenzaA__AHC60347

SEQ ID NO: 41261 - RNA, 1701 nt, Artificial Sequence; identical to SEQ ID NO: 41099
  hemagglutinin__InfluenzaA__AHC60359

SEQ ID NO: 41262 - RNA, 1701 nt, Artificial Sequence; identical to SEQ ID NO: 41183
  hemagglutinin__InfluenzaA__AHC60371

SEQ ID NO: 41263 - RNA, 1701 nt, Artificial Sequence
  hemagglutinin__InfluenzaA__AHC60383
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41264 - RNA, 1701 nt, Artificial Sequence; identical to SEQ ID NO: 41198
  hemagglutinin__InfluenzaA__AHC60395

SEQ ID NO: 41265 - RNA, 1701 nt, Artificial Sequence; identical to SEQ ID NO: 41197
  hemagglutinin__InfluenzaA__AHC60407

SEQ ID NO: 41266 - RNA, 1701 nt, Artificial Sequence
  hemagglutinin__InfluenzaA__AHC60419
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucggaaaugaacaaacuguuugaaaaaacaaagaagcaacugagggaaaaugcugaggauaugggcaaugguuguuucaaaauauaccacaaaugugacaaugccuguauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41267 - RNA, 1701 nt, Artificial Sequence; identical to SEQ ID NO: 41099
  hemagglutinin__InfluenzaA__AHC60431

SEQ ID NO: 41268 - RNA, 1701 nt, Artificial Sequence; identical to SEQ ID NO: 41195
  hemagglutinin__InfluenzaA__AHC60455

SEQ ID NO: 41269 - RNA, 1701 nt, Artificial Sequence; identical to SEQ ID NO: 41195
  hemagglutinin__InfluenzaA__AHC60467

SEQ ID NO: 41270 - RNA, 1701 nt, Artificial Sequence; identical to SEQ ID NO: 41150
  hemagglutinin__InfluenzaA__AHC60479

SEQ ID NO: 41271 - RNA, 1701 nt, Artificial Sequence; identical to SEQ ID NO: 41110
  hemagglutinin__InfluenzaA__AHC60491

SEQ ID NO: 41272 - RNA, 1701 nt, Artificial Sequence
  hemagglutinin__InfluenzaA__AHC60503
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuugcguuguuuuguugggguucaucaugugggccugccaaaaaggcaacauuaggugcaacauuugcauuuga

SEQ ID NO: 41273 - RNA, 1701 nt, Artificial Sequence; identical to SEQ ID NO: 41100
  hemagglutinin__InfluenzaA__AHC60515

SEQ ID NO: 41274 - RNA, 1701 nt, Artificial Sequence; identical to SEQ ID NO: 38756
  hemagglutinin__InfluenzaA__AHC60527

SEQ ID NO: 41275 - RNA, 1701 nt, Artificial Sequence; identical to SEQ ID NO: 41100
  hemagglutinin__InfluenzaA__AHC60539

SEQ ID NO: 41276 - RNA, 1701 nt, Artificial Sequence; identical to SEQ ID NO: 41213
  hemagglutinin__InfluenzaA__AHC60551

SEQ ID NO: 41277 - RNA, 1701 nt, Artificial Sequence
  hemagglutinin__InfluenzaA__AHC60563
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucuucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaaugggagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucuggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41278 - RNA, 1701 nt, Artificial Sequence
  hemagglutinin__InfluenzaA__AHC60575
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41279 - RNA, 1701 nt, Artificial Sequence
  hemagglutinin__InfluenzaA__AHC60587
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucagaaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41280 - RNA, 1701 nt, Artificial Sequence; identical to SEQ ID NO: 41124
  hemagglutinin__InfluenzaA__AHC60599

SEQ ID NO: 41281 - RNA, 1701 nt, Artificial Sequence; identical to SEQ ID NO: 38861
  hemagglutinin__InfluenzaA__AHC60611

SEQ ID NO: 41282 - RNA, 1701 nt, Artificial Sequence
  hemagglutinin__InfluenzaA__AHC60623
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucuucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaaaugggaaaagcucaauaaugagaucagaugcacccauuggcaaaugcaauucugaaugcaucacuccaaaugggagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41283 - RNA, 1701 nt, Artificial Sequence
  hemagglutinin__InfluenzaA__AHC60635
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggauaaggaccaaaucuuccuguaugcucaaucuucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaaugggagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucuggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41284 - RNA, 1701 nt, Artificial Sequence
  hemagglutinin__InfluenzaA__AHC60647
augaagacuaucauugcuuugagcuacauucuaugucugguuuucacucaaaaacuuccuggaaaugacaacagcacggcaacgcugugccuugggcaccaugcaguaccaaauggaacgauagugaaaacaaucacgaaugaccaaauugaaguuacuaaugcuacugagcugguucagaauuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41285 - RNA, 1701 nt, Artificial Sequence
  hemagglutinin__InfluenzaA__AHC60659
augaagacuaucauugcuuugagcuacauucuaugucugguuuucacucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguuaacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41286 - RNA, 1701 nt, Artificial Sequence
  hemagglutinin__InfluenzaA__AHC60671
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaaggaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucaugcuuuuugcuuuguguugcuuuguugggguucaucaugugggccugccaaaaaggcaacauuaggugcaacauuugcauuuga

SEQ ID NO: 41287 - RNA, 1701 nt, Artificial Sequence
  hemagglutinin__InfluenzaA__AHC60683
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaauaagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41288 - RNA, 1701 nt, Artificial Sequence
  hemagglutinin__InfluenzaA__AHC60695
augaagacuaucauugcuuugagcuacauucuaugucugguuuucgcucaaaaacuuccugggaaugacaacagcacggcaacgcugugccuugggcaccaugcagugccaaacggaacgauagugaaaacaaucacgaaugaccaaauugaaguuacuaaugcuacugaacugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuauccuuaugaugugccggauuaugccucccuuaggucacuaguugccucauccggcacacuggaguuuaacaaugaaagcuucaauuggacuggagucacucaaaacggaacaagcucugcuugcaugaggggaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucaccccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucaaauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41289 - RNA, 1701 nt, Artificial Sequence
  hemagglutinin__InfluenzaA__AHC60707
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacggaugaccaaauugaaguuacuaaugcuacugagcugguucagaauuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggaucauauggauuuccuuugccauaucauguuuuuugcuuuguguugcuuuguugggguucaucaugugggccugccaaaaaggcaacauuaggugcaacauuugcauuuga

SEQ ID NO: 41290 - RNA, 1701 nt, Artificial Sequence; identical to SEQ ID NO: 41195
  hemagglutinin__InfluenzaA__AHC60719

SEQ ID NO: 41291 - RNA, 1701 nt, Artificial Sequence; identical to SEQ ID NO: 41100
  hemagglutinin__InfluenzaA__AHC60731

SEQ ID NO: 41292 - RNA, 1701 nt, Artificial Sequence; identical to SEQ ID NO: 41197
  hemagglutinin__InfluenzaA__AHC60743

SEQ ID NO: 41293 - RNA, 1701 nt, Artificial Sequence
  hemagglutinin__InfluenzaA__AHC60767
augaagacuaucauugcuuugagcuacauucuaugucugguuuucgcucaaaaacuuccuggaaaugacaacagcacggcaacgcugugccuugggcaccaugcaguaccgaacggaacgauagugaaaacaaucacgaaugaccaaauugaaguuacuaaugcuacugagcugguccagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacugacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41294 - RNA, 1701 nt, Artificial Sequence
  hemagglutinin__InfluenzaA__AHC60779
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagauucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaauggaaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuagagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41295 - RNA, 1701 nt, Artificial Sequence; identical to SEQ ID NO: 41126
  hemagglutinin__InfluenzaA__AHC60791

SEQ ID NO: 41296 - RNA, 1701 nt, Artificial Sequence; identical to SEQ ID NO: 41155
  hemagglutinin__InfluenzaA__AHC60803

SEQ ID NO: 41297 - RNA, 1701 nt, Artificial Sequence; identical to SEQ ID NO: 41231
  hemagglutinin__InfluenzaA__AHC60815

SEQ ID NO: 41298 - RNA, 1701 nt, Artificial Sequence
  hemagglutinin__InfluenzaA__AHC60827
augaagacuaucauugcuuugagcuacauucuaugucugguuuucgcucaaaaacuuccugggaaugacaacagcacggcaacgcugugccuugggcaccaugcagugccaaacggaacgauagugaaaacaaucacgaaugaccaaauugaaguuacuaaugcuacugaacugguucagaguuccucaacagaugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggggaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucaccccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41299 - RNA, 1701 nt, Artificial Sequence; identical to SEQ ID NO: 41133
  hemagglutinin__InfluenzaA__AHC60839

SEQ ID NO: 41300 - RNA, 1701 nt, Artificial Sequence; identical to SEQ ID NO: 41100
  hemagglutinin__InfluenzaA__AHC60851

SEQ ID NO: 41301 - RNA, 1701 nt, Artificial Sequence
  hemagglutinin__InfluenzaA__AHC60863
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguuaacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaaggcaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41302 - RNA, 1701 nt, Artificial Sequence; identical to SEQ ID NO: 41099
  hemagglutinin__InfluenzaA__AHC60875

SEQ ID NO: 41303 - RNA, 1701 nt, Artificial Sequence; identical to SEQ ID NO: 41216
  hemagglutinin__InfluenzaA__AHC60887

SEQ ID NO: 41304 - RNA, 1701 nt, Artificial Sequence; identical to SEQ ID NO: 41293
  hemagglutinin__InfluenzaA__AHC60899

SEQ ID NO: 41305 - RNA, 1701 nt, Artificial Sequence; identical to SEQ ID NO: 41110
  hemagglutinin__InfluenzaA__AHC60911

SEQ ID NO: 41306 - RNA, 1701 nt, Artificial Sequence
  hemagglutinin__InfluenzaA__AHC60923
augaagacuaucauugcuuugagcuacauucuaugucugguuuucgcucaaaaacuuccugggaaugacaacagcacggcaacgcugugccuugggcaccaugcagugccaaacggaacgauagugaaaacaaucacgaaugaccaaauugaaguuacuaaugcuacugaacugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggggaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauauuggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41307 - RNA, 1701 nt, Artificial Sequence; identical to SEQ ID NO: 38756
  hemagglutinin__InfluenzaA__AHC60935

SEQ ID NO: 41308 - RNA, 1701 nt, Artificial Sequence
  hemagglutinin__InfluenzaA__AHC60947
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuagaucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41309 - RNA, 1701 nt, Artificial Sequence; identical to SEQ ID NO: 38756
  hemagglutinin__InfluenzaA__AHC60959

SEQ ID NO: 41310 - RNA, 1701 nt, Artificial Sequence; identical to SEQ ID NO: 41195
  hemagglutinin__InfluenzaA__AHC60971

SEQ ID NO: 41311 - RNA, 1701 nt, Artificial Sequence
  hemagglutinin__InfluenzaA__AHC60983
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaggaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41312 - RNA, 1701 nt, Artificial Sequence; identical to SEQ ID NO: 41126
  hemagglutinin__InfluenzaA__AHC61007

SEQ ID NO: 41313 - RNA, 1701 nt, Artificial Sequence; identical to SEQ ID NO: 41095
  hemagglutinin__InfluenzaA__AHC61019

SEQ ID NO: 41314 - RNA, 1701 nt, Artificial Sequence
  hemagglutinin__InfluenzaA__AHC61031
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccauuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuugcguuguuuuguugggguucaucaugugggccugccaaaaaggcaacauuaggugcaacauuugcauuuga

SEQ ID NO: 41315 - RNA, 1701 nt, Artificial Sequence; identical to SEQ ID NO: 41098
  hemagglutinin__InfluenzaA__AHC61043

SEQ ID NO: 41316 - RNA, 1701 nt, Artificial Sequence
  hemagglutinin__InfluenzaA__AHC61055
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguuaacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucagaaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41317 - RNA, 1701 nt, Artificial Sequence; identical to SEQ ID NO: 41183
  hemagglutinin__InfluenzaA__AHC61067

SEQ ID NO: 41318 - RNA, 1701 nt, Artificial Sequence
  hemagglutinin__InfluenzaA__AHC61079
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcuccgcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41319 - RNA, 1701 nt, Artificial Sequence; identical to SEQ ID NO: 41099
  hemagglutinin__InfluenzaA__AHC61103

SEQ ID NO: 41320 - RNA, 1701 nt, Artificial Sequence; identical to SEQ ID NO: 41099
  hemagglutinin__InfluenzaA__AHC61115

SEQ ID NO: 41321 - RNA, 1701 nt, Artificial Sequence; identical to SEQ ID NO: 38756
  hemagglutinin__InfluenzaA__AHC61127

SEQ ID NO: 41322 - RNA, 1701 nt, Artificial Sequence
  hemagglutinin__InfluenzaA__AHC61139
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuacccaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41323 - RNA, 1701 nt, Artificial Sequence; identical to SEQ ID NO: 41099
  hemagglutinin__InfluenzaA__AHC61151

SEQ ID NO: 41324 - RNA, 1701 nt, Artificial Sequence
  hemagglutinin__InfluenzaA__AHC61163
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaaaaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaguuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaauggcugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaucacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41325 - RNA, 1701 nt, Artificial Sequence; identical to SEQ ID NO: 38756
  hemagglutinin__InfluenzaA__AHC61175

SEQ ID NO: 41326 - RNA, 1701 nt, Artificial Sequence; identical to SEQ ID NO: 41099
  hemagglutinin__InfluenzaA__AHC61187

SEQ ID NO: 41327 - RNA, 1701 nt, Artificial Sequence; identical to SEQ ID NO: 41101
  hemagglutinin__InfluenzaA__AHC61199

SEQ ID NO: 41328 - RNA, 1701 nt, Artificial Sequence
  hemagglutinin__InfluenzaA__AHC61211
augaagacuaucauugcuuugagcuacauucuaugucugguuuucgcucaaaaacuuccugggaaugacaacagcacggcaacgcugugccuugggcaccaugcagugccaaacggaacgauagugaaaacaaucacgaaugaccaaauugaaguuacuaaugcuacugaacugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggggaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacgguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41329 - RNA, 1701 nt, Artificial Sequence; identical to SEQ ID NO: 41195
  hemagglutinin__InfluenzaA__AHC61223

SEQ ID NO: 41330 - RNA, 1701 nt, Artificial Sequence; identical to SEQ ID NO: 41164
  hemagglutinin__InfluenzaA__AHC61235

SEQ ID NO: 41331 - RNA, 1701 nt, Artificial Sequence; identical to SEQ ID NO: 38756
  hemagglutinin__InfluenzaA__AHC61247

SEQ ID NO: 41332 - RNA, 1701 nt, Artificial Sequence; identical to SEQ ID NO: 38756
  hemagglutinin__InfluenzaA__AHC61259

SEQ ID NO: 41333 - RNA, 1701 nt, Artificial Sequence; identical to SEQ ID NO: 41100
  hemagglutinin__InfluenzaA__AHC61271

SEQ ID NO: 41334 - RNA, 1701 nt, Artificial Sequence
  hemagglutinin__InfluenzaA__AHC61283
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucggaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41335 - RNA, 1701 nt, Artificial Sequence; identical to SEQ ID NO: 41124
  hemagglutinin__InfluenzaA__AHC61295

SEQ ID NO: 41336 - RNA, 1701 nt, Artificial Sequence
  hemagglutinin__InfluenzaA__AHC61307
augaagacuaucauugcuuugagcuacauucuaugucugguuuucgcucaaaaacuuccugggaaugacaacagcacggcaacgcugugccuugggcaccaugcagugccaaacggaacgauagugaaaacaaucacgaaugaccaaauugaaguuacuaaugcuacugaacugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggggaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucaccccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggagaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41337 - RNA, 1701 nt, Artificial Sequence; identical to SEQ ID NO: 41119
  hemagglutinin__InfluenzaA__AHC61319

SEQ ID NO: 41338 - RNA, 1701 nt, Artificial Sequence
  hemagglutinin__InfluenzaA__AHC61331
augaagacuaucauugcuuugagcuacauucuaugucugguuuucgcucaaaaacuuccugggaaugacaacagcacggcaacgcugugccuugggcaccaugcagugccaaacggaacgauagugaaaacaaucacgaaugaccaaauugaaguuacuaaugcuacugaacugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggggaucuaauaauaguuucuuuaguagauugaauugguugacccacuuaaacuucaaauacccagcauugaacgugacuaugccaaacaaugaacaauuugacaaauuguacauuugggggguucaccacccggguacggauaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41339 - RNA, 1701 nt, Artificial Sequence
  hemagglutinin__InfluenzaA__AHC61343
augaagacuaucauugcuuugagcuacauucuaugucugguuuucgcucaaaaacuuccugggaaugacaacagcacggcaacgcugugccuugggcaccaugcagugccaaacggaacgauagugaaaacaaucacgaaugaccaaauugaaguuacuaaugcuacugaacugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggggaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacgguaucuaccaaaagaagccaacaagcuguaauuccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41340 - RNA, 1701 nt, Artificial Sequence
  hemagglutinin__InfluenzaA__AHC61355
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucgggucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauauggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41341 - RNA, 1701 nt, Artificial Sequence; identical to SEQ ID NO: 41195
  hemagglutinin__InfluenzaA__AHC61367

SEQ ID NO: 41342 - RNA, 1701 nt, Artificial Sequence
  hemagglutinin__InfluenzaA__AHC61379
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuaccaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaauggcugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaaguugaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaucacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41343 - RNA, 1701 nt, Artificial Sequence; identical to SEQ ID NO: 41195
  hemagglutinin__InfluenzaA__AHC61391

SEQ ID NO: 41344 - RNA, 1701 nt, Artificial Sequence
  hemagglutinin__InfluenzaA__AHC61403
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuaccaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccuguuccagauauguuaagcaaaacacucugaaauuggcaacaggaaugagaaauguaccagagaaacaaacuagaggcauauuuggcgcaauagcggguuucauagaaaauggcugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaucacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41345 - RNA, 1701 nt, Artificial Sequence; identical to SEQ ID NO: 41099
  hemagglutinin__InfluenzaA__AHC61415

SEQ ID NO: 41346 - RNA, 1701 nt, Artificial Sequence
  hemagglutinin__InfluenzaA__AHC61427
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaauaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaauaagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41347 - RNA, 1701 nt, Artificial Sequence
  hemagglutinin__InfluenzaA__AHC61439
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguuaacccacuuaaacuucaaauacccagcauugaacgugacuaugccaaacaaugaacaauuugacaaauuguacauuugggggguucaccacccggguacggacaaggaucaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucuacaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuucugcuuuguguugcuuuguugggguucaucaugugggccugccaaaaaggcaacauuaggugcaacauuugcauuuga

SEQ ID NO: 41348 - RNA, 1701 nt, Artificial Sequence; identical to SEQ ID NO: 41195
  hemagglutinin__InfluenzaA__AHC61451

SEQ ID NO: 41349 - RNA, 1701 nt, Artificial Sequence
  hemagglutinin__InfluenzaA__AHC61463
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccaucggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41350 - RNA, 1701 nt, Artificial Sequence; identical to SEQ ID NO: 38756
  hemagglutinin__InfluenzaA__AHC61475

SEQ ID NO: 41351 - RNA, 1701 nt, Artificial Sequence; identical to SEQ ID NO: 41215
  hemagglutinin__InfluenzaA__AHC61487

SEQ ID NO: 41352 - RNA, 1701 nt, Artificial Sequence; identical to SEQ ID NO: 38756
  hemagglutinin__InfluenzaA__AHC61499

SEQ ID NO: 41353 - RNA, 1701 nt, Artificial Sequence; identical to SEQ ID NO: 41195
  hemagglutinin__InfluenzaA__AHC61511

SEQ ID NO: 41354 - RNA, 1701 nt, Artificial Sequence
  hemagglutinin__InfluenzaA__AHC61523
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccguaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaaugggagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41355 - RNA, 1701 nt, Artificial Sequence
  hemagglutinin__InfluenzaA__AHC61535
augaagacuaucauugcuuugagcuacauucuaugucugguuuucgcucaaaaacuuccuggaaaugacaacagcacggcaacgcugugccuugggcaccaugcagugccgaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacaguacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggaaggaaugguggaugguugguacgguuucaggcaucaaaauucugagggaaggggacaagcagcagaucucaaaagcacucaagcagcaaucgaucaaaucaaugggaagcuaaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaccaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41356 - RNA, 1701 nt, Artificial Sequence; identical to SEQ ID NO: 41195
  hemagglutinin__InfluenzaA__AHC61547

SEQ ID NO: 41357 - RNA, 1701 nt, Artificial Sequence
  hemagglutinin__InfluenzaA__AHC61559
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagaucauugauggagaaaacugcacacuaauagaugcucuauugggagacccucagugugauggcuuccaaaauaagaaaugggaccuuuuuguugaacgaagcaaggccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaguuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucaggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucagggcacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41358 - RNA, 1701 nt, Artificial Sequence; identical to SEQ ID NO: 41124
  hemagglutinin__InfluenzaA__AHC61571

SEQ ID NO: 41359 - RNA, 1701 nt, Artificial Sequence; identical to SEQ ID NO: 41195
  hemagglutinin__InfluenzaA__AHC61583

SEQ ID NO: 41360 - RNA, 1701 nt, Artificial Sequence; identical to SEQ ID NO: 41250
  hemagglutinin__InfluenzaA__AHC61595

SEQ ID NO: 41361 - RNA, 1701 nt, Artificial Sequence
  hemagglutinin__InfluenzaA__AHC61607
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaacacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41362 - RNA, 1701 nt, Artificial Sequence; identical to SEQ ID NO: 41124
  hemagglutinin__InfluenzaA__AHC61619

SEQ ID NO: 41363 - RNA, 1701 nt, Artificial Sequence
  hemagglutinin__InfluenzaA__AHC61631
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacaauaauagaugcucuauugggagacccucagugugauggcuuccaaaacaagaaaugggaucuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguuaacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41364 - RNA, 1701 nt, Artificial Sequence
  hemagglutinin__InfluenzaA__AHC61643
augaagacuaucauugcuuugagcuacguucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagaaaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucggaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41365 - RNA, 1701 nt, Artificial Sequence
  hemagglutinin__InfluenzaA__AHC61655
augaagacuaucauugcuuugagcuacauucuaugucugguuuucacucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaauaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaauaagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41366 - RNA, 1701 nt, Artificial Sequence
  hemagglutinin__InfluenzaA__AHC61667
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugaucaacagcacagggaaucugauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaauagaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41367 - RNA, 1701 nt, Artificial Sequence; identical to SEQ ID NO: 41328
  hemagglutinin__InfluenzaA__AHC61679

SEQ ID NO: 41368 - RNA, 1701 nt, Artificial Sequence; identical to SEQ ID NO: 41238
  hemagglutinin__InfluenzaA__AHC61691

SEQ ID NO: 41369 - RNA, 1701 nt, Artificial Sequence; identical to SEQ ID NO: 41174
  hemagglutinin__InfluenzaA__AHC61703

SEQ ID NO: 41370 - RNA, 1701 nt, Artificial Sequence; identical to SEQ ID NO: 41177
  hemagglutinin__InfluenzaA__AHC61715

SEQ ID NO: 41371 - RNA, 1701 nt, Artificial Sequence; identical to SEQ ID NO: 38756
  hemagglutinin__InfluenzaA__AHC61727

SEQ ID NO: 41372 - RNA, 1701 nt, Artificial Sequence; identical to SEQ ID NO: 41153
  hemagglutinin__InfluenzaA__AHC61739

SEQ ID NO: 41373 - RNA, 1701 nt, Artificial Sequence
  hemagglutinin__InfluenzaA__AHC61751
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaaugucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41374 - RNA, 1701 nt, Artificial Sequence
  hemagglutinin__InfluenzaA__AHC61763
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaaacuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41375 - RNA, 1701 nt, Artificial Sequence
  hemagglutinin__InfluenzaA__AHC61775
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaauaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaauggcugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaucacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41376 - RNA, 1701 nt, Artificial Sequence; identical to SEQ ID NO: 38756
  hemagglutinin__InfluenzaA__AHC61787

SEQ ID NO: 41377 - RNA, 1701 nt, Artificial Sequence; identical to SEQ ID NO: 41328
  hemagglutinin__InfluenzaA__AHC61799

SEQ ID NO: 41378 - RNA, 1701 nt, Artificial Sequence
  hemagglutinin__InfluenzaA__AHC61823
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugaaaucagaugcacccauugacaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaaacugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41379 - RNA, 1701 nt, Artificial Sequence; identical to SEQ ID NO: 38756
  hemagglutinin__InfluenzaA__AHC61835

SEQ ID NO: 41380 - RNA, 1701 nt, Artificial Sequence; identical to SEQ ID NO: 41099
  hemagglutinin__InfluenzaA__AHC61847

SEQ ID NO: 41381 - RNA, 1701 nt, Artificial Sequence
  hemagglutinin__InfluenzaA__AHC61859
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguuaacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuucugcuuuguguugcuuuguugggguucaucaugugggccugccaaaaaggcaacauuaggugcaacauuugcauuuga

SEQ ID NO: 41382 - RNA, 1701 nt, Artificial Sequence; identical to SEQ ID NO: 38756
  hemagglutinin__InfluenzaA__AHC61871

SEQ ID NO: 41383 - RNA, 1701 nt, Artificial Sequence
  hemagglutinin__InfluenzaA__AHC61883
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguaugguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuagcugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41384 - RNA, 1701 nt, Artificial Sequence; identical to SEQ ID NO: 41100
  hemagglutinin__InfluenzaA__AHC61895

SEQ ID NO: 41385 - RNA, 1701 nt, Artificial Sequence; identical to SEQ ID NO: 41099
  hemagglutinin__InfluenzaA__AHC61907

SEQ ID NO: 41386 - RNA, 1701 nt, Artificial Sequence
  hemagglutinin__InfluenzaA__AHC61931
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagguuggauccuauggauuuccuuugccauaucauguuuuuugcuuuguguugcuuuguugggguucaucaugugggccugccaaaaaggcaacauuaggugcaacauuugcauuuga

SEQ ID NO: 41387 - RNA, 1701 nt, Artificial Sequence
  hemagglutinin__InfluenzaA__AHC61943
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucuuaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41388 - RNA, 1701 nt, Artificial Sequence; identical to SEQ ID NO: 39928
  hemagglutinin__InfluenzaA__AHC61955

SEQ ID NO: 41389 - RNA, 1701 nt, Artificial Sequence; identical to SEQ ID NO: 38756
  hemagglutinin__InfluenzaA__AHC61967

SEQ ID NO: 41390 - RNA, 1701 nt, Artificial Sequence; identical to SEQ ID NO: 41195
  hemagglutinin__InfluenzaA__AHC61979

SEQ ID NO: 41391 - RNA, 1701 nt, Artificial Sequence; identical to SEQ ID NO: 41100
  hemagglutinin__InfluenzaA__AHC61991

SEQ ID NO: 41392 - RNA, 1701 nt, Artificial Sequence
  hemagglutinin__InfluenzaA__AHC62003
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugaacugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaaaaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaauggcugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaucacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41393 - RNA, 1701 nt, Artificial Sequence; identical to SEQ ID NO: 38756
  hemagglutinin__InfluenzaA__AHC62015

SEQ ID NO: 41394 - RNA, 1701 nt, Artificial Sequence; identical to SEQ ID NO: 41203
  hemagglutinin__InfluenzaA__AHC62027

SEQ ID NO: 41395 - RNA, 1701 nt, Artificial Sequence
  hemagglutinin__InfluenzaA__AHC62039
augaagacuaucauugcuuugagcuacauucuaugucugguuuucgcucaaaaacuuccugggaaugacaacagcacggcaacgcugugccuugggcaccaugcagugccaaacggaacgauagugaaaacaaucacgaaugaccaaauugaaguuacuaaugcuacugaacugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggggaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugaaaucagaugcacccauuggcaaaugcaauucugcaugcaucacuccaaauggaagcauucccaaugacaaaccauuccaaaauguaaacaggaucacauacggggccugucccagauauguuaagcaaaacacuuugaaauuggcaacaggaaugagaaauguaccagagaaacaaacuagaggcauauuuggcgcaauagcggguuucauagaaaaugguugggagggaaugauggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauucuauggauuuccuuugccauaucauguuuuuugcuuuguguugcuuuguugggguucaucaugugggccugccaaaaaggcaacauuaggugcaacauuugcauuuga

SEQ ID NO: 41396 - RNA, 1701 nt, Artificial Sequence
  hemagglutinin__InfluenzaA__AHC62050
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuaccaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaaugucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaauggcugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaucacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41397 - RNA, 1701 nt, Artificial Sequence
  hemagglutinin__InfluenzaA__AHC62062
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaauagaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41398 - RNA, 1701 nt, Artificial Sequence
  hemagglutinin__InfluenzaA__AHC62074
augaagacuaucauugcuuugagcuacauucuaugucugguuuucgcucaaaaacuuccuggaaaugacaacagcacggcaacgcugugccuugggcaccaugcaguaccgaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacugacaaggaccaaaucuuccuguaugcucaagcaucaggaagaaucacaguaucuaccaaaagaaaccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41399 - RNA, 1701 nt, Artificial Sequence; identical to SEQ ID NO: 41195
  hemagglutinin__InfluenzaA__AHC62086

SEQ ID NO: 41400 - RNA, 1701 nt, Artificial Sequence; identical to SEQ ID NO: 41110
  hemagglutinin__InfluenzaA__AHC62098

SEQ ID NO: 41401 - RNA, 1701 nt, Artificial Sequence; identical to SEQ ID NO: 41195
  hemagglutinin__InfluenzaA__AHC62110

SEQ ID NO: 41402 - RNA, 1701 nt, Artificial Sequence
  hemagglutinin__InfluenzaA__AHC62122
augaagacuaucauugcuuugagcuacauucuaugucugguuuucgcucaaaaacuuccugggaaugacaacagcacggcaacgcugugccuugggcaccaugcagugccaaacggaacgauagugaaaacaaucacgaaugaccaaauugaaguuacuaaugcuacugaaaugguucagaguuccucaacaggugaaauaugcaacaguccucaccagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucaucuggcacacuggaguuuaacaaugaaagcuucaauuggacuggagucacucaaaacggaacaagcucugcuugcauaaggggaucuaauaauaguuucuuuaguagauugaauugguugacccacucaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugauucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccggaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41403 - RNA, 1701 nt, Artificial Sequence
  hemagglutinin__InfluenzaA__AHC62134
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuaccccuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggaggggaugguggaugguugguacgguuucaggcaucaaaacucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcagagcuucuuguugcccuggagaaucaacacacaauugaucuaacugacucagaaaugaacaaacuguuugaaaaaacaaagaagcagcugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41404 - RNA, 1701 nt, Artificial Sequence
  hemagglutinin__InfluenzaA__AHC62146
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagacugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucuucaggaagaaucacaguaucuaccaaaagaagccaacaagcuguaaucccgaauaucggaucuagacccagaauaaggaauaucccuagcagaauaaguaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaaugggagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauuaugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucuggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41405 - RNA, 1701 nt, Artificial Sequence; identical to SEQ ID NO: 41099
  hemagglutinin__InfluenzaA__AHC62158

SEQ ID NO: 41406 - RNA, 1701 nt, Artificial Sequence
  hemagglutinin__InfluenzaA__AHC62170
augaagacuaucauugcuuugagcuacauucuaugucugguuuucgcucaaaaacuuccugggaaugacaacagcacggcaacgcugugccuugggcaccaugcagugccaaacggaacgauagugaaaacaaucacgaaugaccaaauugaaguuacuaaugcuacugaacugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggggaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccuaauaucggaucuagacccagaguaaggaacaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugauggaugguugguacgguuucaggcaucaaaacucugagggaaggggacaagcagcagaucucaaaagcacucaagcagcaaucgaucaaaucaaugggaagcugaauagauugaucggaaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41407 - RNA, 1701 nt, Artificial Sequence; identical to SEQ ID NO: 41143
  hemagglutinin__InfluenzaA__AHC62182

SEQ ID NO: 41408 - RNA, 1701 nt, Artificial Sequence; identical to SEQ ID NO: 41278
  hemagglutinin__InfluenzaA__AHC62194

SEQ ID NO: 41409 - RNA, 1701 nt, Artificial Sequence
  hemagglutinin__InfluenzaA__AHC62206
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucauuuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggauaaggaccaaaucuuccuguaugcucaaucuucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaaugggagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucuggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41410 - RNA, 1701 nt, Artificial Sequence
  hemagglutinin__InfluenzaA__AHC62218
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaaguugaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41411 - RNA, 1701 nt, Artificial Sequence
  hemagglutinin__InfluenzaA__AHC62242
augaagacuaucauugcuuugagcuacauucuaugucugguuuucgcucaaaaaauuccuggaaaugacaacagcacggcaacgcuaugccuugggcaccaugcaguaccaaacggaacgauagugaaaacaaucacgaaugaccaaauugaaguuacuaaugcuacugagcugguucagaauuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuauugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41412 - RNA, 1701 nt, Artificial Sequence; identical to SEQ ID NO: 41222
  hemagglutinin__InfluenzaA__AHC62254

SEQ ID NO: 41413 - RNA, 1701 nt, Artificial Sequence; identical to SEQ ID NO: 41119
  hemagglutinin__InfluenzaA__AHC62266

SEQ ID NO: 41414 - RNA, 1701 nt, Artificial Sequence; identical to SEQ ID NO: 41285
  hemagglutinin__InfluenzaA__AHC62278

SEQ ID NO: 41415 - RNA, 1701 nt, Artificial Sequence
  hemagglutinin__InfluenzaA__AHC62290
augaagacuaucauugcuuugagcuacauucuaugucugauuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41416 - RNA, 1701 nt, Artificial Sequence
  hemagglutinin__InfluenzaA__AHC62302
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaaaugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcugaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucggaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41417 - RNA, 1701 nt, Artificial Sequence
  hemagglutinin__InfluenzaA__AHC62314
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaggggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41418 - RNA, 1701 nt, Artificial Sequence; identical to SEQ ID NO: 41282
  hemagglutinin__InfluenzaA__AHC62326

SEQ ID NO: 41419 - RNA, 1701 nt, Artificial Sequence; identical to SEQ ID NO: 38756
  hemagglutinin__InfluenzaA__AHC62338

SEQ ID NO: 41420 - RNA, 1701 nt, Artificial Sequence
  hemagglutinin__InfluenzaA__AHC62350
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagauccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41421 - RNA, 1701 nt, Artificial Sequence; identical to SEQ ID NO: 38756
  hemagglutinin__InfluenzaA__AHC62362

SEQ ID NO: 41422 - RNA, 1701 nt, Artificial Sequence
  hemagglutinin__InfluenzaA__AHC62374
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaaugagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41423 - RNA, 1701 nt, Artificial Sequence; identical to SEQ ID NO: 41285
  hemagglutinin__InfluenzaA__AHC62386

SEQ ID NO: 41424 - RNA, 1701 nt, Artificial Sequence; identical to SEQ ID NO: 41195
  hemagglutinin__InfluenzaA__AHC62398

SEQ ID NO: 41425 - RNA, 1701 nt, Artificial Sequence
  hemagglutinin__InfluenzaA__AHC62410
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuaccaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaauaagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaauggcugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaucacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41426 - RNA, 1701 nt, Artificial Sequence; identical to SEQ ID NO: 41228
  hemagglutinin__InfluenzaA__AHC62422

SEQ ID NO: 41427 - RNA, 1701 nt, Artificial Sequence
  hemagglutinin__InfluenzaA__AHC62434
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacaaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41428 - RNA, 1701 nt, Artificial Sequence; identical to SEQ ID NO: 41195
  hemagglutinin__InfluenzaA__AHC62446

SEQ ID NO: 41429 - RNA, 1701 nt, Artificial Sequence; identical to SEQ ID NO: 41100
  hemagglutinin__InfluenzaA__AHC62458

SEQ ID NO: 41430 - RNA, 1701 nt, Artificial Sequence
  hemagglutinin__InfluenzaA__AHC62470
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaauggcaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucggaaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41431 - RNA, 1701 nt, Artificial Sequence
  hemagglutinin__InfluenzaA__AHC62482
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccggguacggaaaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugccccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcugcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41432 - RNA, 1701 nt, Artificial Sequence
  hemagglutinin__InfluenzaA__AHC62506
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuagaucacuaguugccucauccggcacacuggaguuuaacaaugaaagcuucaauuggacuggagucacucaaaacggaacaagcucugcuugcauaaggagaucuaauaauaguuucuuuaguagauugaauugguuaacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41433 - RNA, 1701 nt, Artificial Sequence; identical to SEQ ID NO: 41100
  hemagglutinin__InfluenzaA__AHC62518

SEQ ID NO: 41434 - RNA, 1701 nt, Artificial Sequence
  hemagglutinin__InfluenzaA__AHC62530
augaagacuaucauugcuuugagcuacauucuaugucugguuuucgcucaaaaaauuccuggaaaugacaacagcacggcaacgcugugccuugggcaccaugcagugccaaacggaacgauagugaaaacaaucacgaaugaccaaauugaaguuaccaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaauggcugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaucacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41435 - RNA, 1701 nt, Artificial Sequence; identical to SEQ ID NO: 41155
  hemagglutinin__InfluenzaA__AHC62542

SEQ ID NO: 41436 - RNA, 1701 nt, Artificial Sequence; identical to SEQ ID NO: 41195
  hemagglutinin__InfluenzaA__AHC62554

SEQ ID NO: 41437 - RNA, 1701 nt, Artificial Sequence
  hemagglutinin__InfluenzaA__AHC62566
augaagacuaucauugcuuugagcuacauucuaugucugguuuucgcucaaaaacuuccuggaaaugacaacagcacggcaacgcugugccuugggcaccaugcaguaccaaacggaacgauggugaaaacaaucacgaaugaccaaauugaaguuacuaaugcuacugagcugguucagaauuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41438 - RNA, 1701 nt, Artificial Sequence; identical to SEQ ID NO: 41195
  hemagglutinin__InfluenzaA__AHC62578

SEQ ID NO: 41439 - RNA, 1701 nt, Artificial Sequence
  hemagglutinin__InfluenzaA__AHC62590
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggugcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41440 - RNA, 1701 nt, Artificial Sequence; identical to SEQ ID NO: 41215
  hemagglutinin__InfluenzaA__AHC62602

SEQ ID NO: 41441 - RNA, 1701 nt, Artificial Sequence
  hemagglutinin__InfluenzaA__AHC62614
augaagacuaucauugcuuugagcuacauucuaugucugguuuucgcucaaaaacuuccugggaaugacaacagcacggcaacgcugugccuugggcaccaugcagugccaaacggaacgauagugaaaacaaucacgaaugaccaaauugaaguuacuaaugcuacugaacugguucagaguuccucaacaggugaaauaugcaacaguccucaucagaucauugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggggaucuaauaauaguuucuuuaguagauugaauugguugacccacuuaaacuucaaauacccagcauugaacgugacuaugccaaacaaugaacaauuugacaaauuguacauuugggggguucaccacccagguacagacaaggaccaaaucuuccuguaugcucaagcaucaggaagaaucacaguaucuacuaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccaucggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41442 - RNA, 1701 nt, Artificial Sequence
  hemagglutinin__InfluenzaA__AHC62626
augaagacuaucauugcuuugagcuacauucuaugucugguuuucgcucaaaaacuuccugggaaugacaacagcacggcaacgcugugccuugggcaccaugcagugccaaacggaacgauagugaaaacaaucacgaaugaccaaauugaaguuacuaaugcuacugaacugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggggaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggaaggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41443 - RNA, 1701 nt, Artificial Sequence; identical to SEQ ID NO: 41119
  hemagglutinin__InfluenzaA__AHC62638

SEQ ID NO: 41444 - RNA, 1701 nt, Artificial Sequence
  hemagglutinin__InfluenzaA__AHC62650
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaucaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaaggaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucaugcuuuuugcuuuguguugcuuuguugggguucaucaugugggccugccaaaaaggcaacauuaggugcaacauuugcauuuga

SEQ ID NO: 41445 - RNA, 1701 nt, Artificial Sequence
  hemagglutinin__InfluenzaA__AHC62662
augaagacuaucauugcuuugagcuacauucuaugucugguuuucgcucaaaaacuuccugggaaugacaacagcacggcaacgcugugccuugggcaccaugcagugccaaacggaacgauagugaaaacaaucacgaaugaccaaauugaaguuacuaaugcuacugaacugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcagcuguuacccuuaugaugugccggauuaugccucccuuaggucacuaguugccucauccggcacacuggaguuuaacaaugaaagcuucaauuggacuggagucacucaaaacggaacaagcucugcuugcauaaggggaucuaauaauaguuucuuuaguagauugaauugguugacccacuuaaacuucaaauacccagcacugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucaccccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaaggaagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41446 - RNA, 1701 nt, Artificial Sequence
  hemagglutinin__InfluenzaA__AHC62674
augaagacuaucauugcuuugagcuacauucuaugucugguuuucgcucaaaaacuuccugggaaugacaacagcacggcaacgcugugccuugggcaccaugcagugccaaacggaacgauagugaaaacaaucacgaaugaccaaauugaaguuacuaaugcuacugaacugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugcuucccuuaggucacuaauugccucauccggcacacuggaguuuaacaaugaaagcuucaauuggacuggagucacucaaaacggaacaagcucugcuugcauaaggggaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucaccccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaauaccugcauagaaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41447 - RNA, 1701 nt, Artificial Sequence
  hemagglutinin__InfluenzaA__AHE37972
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucugguucagacaauggaacguguuacccaggagauuucaucgauuaugaggagcuaagagagcaguugagcucagugucaucauuugaaagguuugagauauuccccaaaacaaguucauggccaaaucaugacucgaacaaagguguaacggcagcauguccucaugcuggagcaaaaggcuucuacaaaaauuuaauauggcuaguuaaaaaaggaaauucauacccaaagcucagcauauccuacauuaaugacaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauuugcaauggaaagaaaugcuggaucugguauuaucauuucagauacaccaguucacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugcuggcuucauugaagggggguggacaggaaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugauuacccaaaauacucagaggaagcaaaauuaaacagagaagaaauagaugggguaaagcuggaaucaacaaggauuuaccagauuuuggcgaucuauucaacugccgcuaguucauugguacugguagucucucugggggcaaucaguuuuuggaugugcucuaaugggucucuacaguguagaauauguauuuaa

SEQ ID NO: 41448 - RNA, 1701 nt, Artificial Sequence
  hemagglutinin__InfluenzaA__AHE37973
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaaacauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggaacaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaauaaacuauuacuggacacuaauagagccaggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 41449 - RNA, 1701 nt, Artificial Sequence
  hemagglutinin__InfluenzaA__AHE37974
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaaaauacagcaagaaguucaagccggaaauagcaauaagacccaaagugagggaucaagaagggagaaugaacuauuacuggacacuaauagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 41450 - RNA, 1701 nt, Artificial Sequence
  hemagglutinin__InfluenzaA__AHE37975
augaaggcaauacuaguaguucugcuauauacauuugcaaccgcaaaugcagacacauuauguauagguuaucaugcgaacaauucaacagacacuguagacacagugcuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauccaccauccaucuacuacugcugaccaacaaagucucuaucagaaugcagaugcauauguuuuuguggggacaucaagauacagcaaaaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaauguagaauauguauuuaa

SEQ ID NO: 41451 - RNA, 1701 nt, Artificial Sequence
  hemagglutinin__InfluenzaA__AHE37976
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccgcagcaaguucaugguccuacauuguggaaacaucuaguucaaacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaauccucgugcuguggggcauucaccauccaucuacuacuacugaccaacaaagucucuaucagaaugcggaugcauauguuuuuguggggacaucaagauacagcaagaaguucaagccggaaauagcaauaagacccaaagugagggaucaagaagggagaaugaacuauuacuggacacuaauagagccgggagacaaaauaacauuugaagcaacuggaaaucuagugguaccgagauaugcauucgcaauggaaagaaaugcuggaucugguauuaucauuucagauacaccaguccacgauuguaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagaggaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 41452 - RNA, 1701 nt, Artificial Sequence; identical to SEQ ID NO: 40578
  hemagglutinin__InfluenzaA__AHE37977

SEQ ID NO: 41453 - RNA, 1701 nt, Artificial Sequence
  hemagglutinin__InfluenzaA__AHE37978
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucugguucagacaauggaacguguuacccaggagauuucaucgauuaugaggagcuaagagagcaauugagcucagugucaucauuugaaagguuugagauauuccccaaaacaaguucauggccaaaucaugacucgaacaaagguguaacggcagcauguccucaugcuggagcaaaaggcuucuacaaaaauuuaauauggcuaguuaaaaaaggaaauucauacccaaagcucagcauauccuacauuaaugacaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauuugcaauggaaagaaaugcuggaucugguauuaucauuucagauacaccaguucacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugcuggcuucauugaagggggguggacaggaaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugauuacccaaaauacucagaggaagcaaaauuaaacagagaagaaauagaugggguaaagcuggaaucaacaaggauuuaccagauuuuggcgaucuauucaacugccgcuaguucauugguacugguagucucucugggggcaaucaguuuuuggaugugcucuaaugggucucuacaguguagaauauguauuuaa

SEQ ID NO: 41454 - RNA, 1701 nt, Artificial Sequence
  hemagglutinin__InfluenzaA__AHE37979
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauccaccauccaucuacuacugcugaccaacaaagucucuaucagaaugcagaugcauauguuuuuguggggacaucaagauacagcaaaaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuagacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauugaacagagaaaaaauagauggggugaagcuggaaucaacaaggauuuaccagauuuuggcgaucuauucaacugucgccaguucauugguacugguagucucccugggggcaaucagcuucuggaugugcucuaaugggucucuacaauguagaauauguauuuaa

SEQ ID NO: 41455 - RNA, 1701 nt, Artificial Sequence
  hemagglutinin__InfluenzaA__AHE37980
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguaaccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacagcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaauagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacaucuggacuuacaaugccgaauuguugguucuauuggaaaaugaaagaacuuuggauuaucacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 41456 - RNA, 1701 nt, Artificial Sequence
  hemagglutinin__InfluenzaA__AHE37981
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaaaauacagcaagaaguucaagccggaaauagcaauaagacccaaagugagggaucaagaagggagaaugaacuauuacuggacacuaaucgagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucaucgaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauauacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 41457 - RNA, 1701 nt, Artificial Sequence
  hemagglutinin__InfluenzaA__AHE37982
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacguacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaauggaucucuacaguguagaauauguauuuaa

SEQ ID NO: 41458 - RNA, 1701 nt, Artificial Sequence
  hemagglutinin__InfluenzaA__AHE37983
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaaacauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagggaauucauacccaaagcucagcgaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaauagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacaggaaugguagauggaugguacgguuaucaccaucaaaaugagcaggggucaggauaugcagccgaccugaagagcacacaaaaugccauugacaagauuacuaacaaaguaaauucuguuauugaaaagaugaauacacaauucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 41459 - RNA, 1701 nt, Artificial Sequence
  hemagglutinin__InfluenzaA__AHE37984
auggaggcaauacuaguaguucugcuauacacauuugcaaccgcaaaugcagacacauuauguauagguuaucaugcgaacaauucaacagacacuguagacacaguacuagaaaagaauguaacaguaacccacucuguuaaccuucuagaagacaaacauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaauagagccaggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 41460 - RNA, 1701 nt, Artificial Sequence
  hemagglutinin__InfluenzaA__AHE37985
augaagaccaucauugcuuugagcuacauucuaugucuaguuuucgcucaagaacuuccuggaaaugacgacagcacggcaacacugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccaggagacauacuuuugauuaacagcacagggaaucuaauugcuccuagggguuacuucaaaauacgaagugggaaaagcucaauaaugaaaucagaugcacccauuggcaaaugcaauucugcaugcaucacuccaaauggaagcauucccaaugacaaaccauuccaaaauguaaacaggaucacauauggggccugucccagauaugucaagcaaaacacucugaaauuggcaacaggaaugagaaaugugccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaggggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguguacagagaugaagcauuaaacaaccgauuccagaucaaaggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41461 - RNA, 1701 nt, Artificial Sequence
  hemagglutinin__InfluenzaA__AHE37986
augaagaccaucauugcuuugagcuacauucuaugucuaguuuucgcucaagaacuuccuggaaaugacgacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguauauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguguacagagaugaagcauuaaacaaccgauuccagaucaagggaauugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41462 - RNA, 1701 nt, Artificial Sequence
  hemagglutinin__InfluenzaA__AHE37987
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaguugagcuuaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41463 - RNA, 1701 nt, Artificial Sequence
  hemagglutinin__InfluenzaA__AHE37988
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacgggacaaguucugcuugcauaaggagaucuaauaguaguuucuuuaguagauuaaauugguugacccacuuaaacuucaaauacccagcauugaacgugaccaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugauggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucagaaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41464 - RNA, 1701 nt, Artificial Sequence
  hemagglutinin__InfluenzaA__AHE37989
augaaaacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41465 - RNA, 1701 nt, Artificial Sequence; identical to SEQ ID NO: 40640
  hemagglutinin__InfluenzaA__AHE37990

SEQ ID NO: 41466 - RNA, 1701 nt, Artificial Sequence
  hemagglutinin__InfluenzaA__AHE37991
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucgauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaauggaacaaguucugcuugcauaaggagaucuaauaguaguuucuuuaguagauuaaauugguugacccacuuaaacuucaaauacccagcauugaacgugacuaugccaaacaaugaacaauuugacaaauuguauauuugggggguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaccuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggauaacauacggggccugucccagauauguuaagcaaagcacucugaaauuggcaacaggaaugcgaaauguaccagagaaacaaacuagaggcauauuuggcgcaauagcggguuucauagaaaaugguugggaggggaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41467 - RNA, 1701 nt, Artificial Sequence
  hemagglutinin__InfluenzaA__AHE37992
augaagaccaucauugcuuugagcuacauucuaugucuaguuuucgcucaagaacuuccuggaaaugacgacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuugacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauauggggccugucccagauaugucaagcaaaacacucugaaauuggcaacaggaaugagaaaugugccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaggggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41468 - RNA, 1701 nt, Artificial Sequence
  hemagglutinin__InfluenzaA__AHE38023
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacagcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 41469 - RNA, 1701 nt, Artificial Sequence
  hemagglutinin__InfluenzaA__AHE38024
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgguaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagucaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaacaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggcaacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaacucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 41470 - RNA, 1701 nt, Artificial Sequence
  hemagglutinin__InfluenzaA__AHE38026
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugaaaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaucaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 41471 - RNA, 1701 nt, Artificial Sequence; identical to SEQ ID NO: 40393
  hemagglutinin__InfluenzaA__AHE38027

SEQ ID NO: 41472 - RNA, 1683 nt, Artificial Sequence
  hemagglutinin__InfluenzaA__AHF20558
augaacacucaaauccugguauucgcucugauugcgaucauuccaacaaaugcagacaaaaucugccucggacaucaugccgugucaaacggaaccaaaguaaacacauuaacugaaagaggaguggaagucgucaaugcaacugaaacaguggaacgaacaaacauccccaggaucugcucaaaagggaaaaggacaguugaccucggucaauguggacuccuggggacaaucacuggaccaccucaaugugaccaauuccuagaauuuucagccgauuuaauuauugagaggcgagaaggaagugaugucuguuauccugggaaauucgugaaugaagaagcucugaggcaaauucucagagaaucaggcggaauugacaaggaagcaaugggauucacauacaguggaauaagaacuaauggagcaaccagugcauguaggagaucaggauccucauucuaugcagaaaugaaauggcuccugucaaacacagauaaugcugcauucccgcagaugacuaagucauauaaaaauacaagaaaaagcccagcucuaauaguaugggggauccaucauuccguaucaacugcagagcaaaccaagcuauaugggaguggaaacaaacuggugacaguugggaguucuaauuaucaacaaucuuuuguaccgaguccaggagcgagaccacaaguuaauggucuaucuggaagaauugacuuucauuggcuaaugcuaaaucccaaugauacagucacuuucaguuucaauggggcuuucauagcuccagaccgugcaagcuuccugagaggaaaaucuaugggaauccagaguggaguacagguugaugccaauugugaaggggacugcuaucauaguggagggacaauaauaaguaacuugccauuucagaacauagauagcagggcaguuggaaaauguccgagauauguuaagcaaaggagucugcugcuagcaacagggaugaagaauguuccugagauuccaaagggaagaggccuauuuggugcuauagcggguuucauugaaaauggaugggaaggccuaauugaugguugguauggcuucagacaccagaaugcacagggagagggaacugcugcagauuacaaaagcacucaaucggcaauugaucaaauaacaggaaaauuaaaccggcuuauagaaaaaaccaaccaacaauuugaguugauagacaaugaauucaaugagguagagaagcaaaucgguaaugugauaaauuggaccagagauucuauaacagaaguguggucauacaaugcugaacucuugguagcaauggagaaccagcauacaauugaucuggcugauucagaaauggacaaacuguacgaacgagugaaaagacagcugagagagaaugcugaagaagauggcacugguugcuuugaaauauuucacaagugugaugaugacuguauggccaguauuagaaauaacaccuaugaucacagcaaauacagggaagaggcaaugcaaaauagaauacagauugacccagucaaacuaagcagcggcuacaaagaugugauacuuugguuuagcuucggggcaucauguuucauacuucuagccauuguaaugggccuugucuucauauguguacagaauggaaacaugcggugcacuauugguauauaa

SEQ ID NO: 41473 - RNA, 1683 nt, Artificial Sequence
  hemagglutinin__InfluenzaA__AHF20568
augaacacucaaauccugguauucgcucugauugcgaucauuccaacaaaugcagacaaaaucugccucggacaucaugccgugucaaacggaaccaaaguaaacacauuaacugaaagaggaguggaagucgucaaugcaacugaaacaguggaacgaacaaacauccccaggaucugcucaaaagggaaaaggacaguugaccucggucaauguggacuccuggggacaaucacuggaccaccucaaugugaccaauuccuagaauuuucagccgauuuaauuauugagaggcgagaaggaagugaugucuguuauccugggaaauucgugaaugaagaagcucugaggcaaauucucagagaaucaggcggaauugacaaggaagcaaugggauucacauacaguggaauaagaacuaauggagcaaccagugcauguaggagaucaggaucuucauucuaugcagaaaugaaauggcuccugucaaacacagauaaugcugcauucccgcagaugacuaagucauauaaaaauacaagaaaaagcccagcucuaauaguaugggggauccaucauuccguaucaacugcagagcaaaccaagcuauaugggaguggaaacaaacuggugacaguugggaguucuaauuaucaacaaucuuuuguaccgaguccaggagcgagaccacaaguuaauggucuaucuggaagaauugacuuucauuggcuaaugcuaaaccccaaugauacagucacuuucaguuucaauggggcuuucauagcuccagaccgugcaagcuuccugagaggaaaaucuaugggaauccagaguggaguacagguugaugccaauugugaaggggacugcuaucauaguggagggacaauaaugaguaacuugccauuucagaauauagauagcagggcaguuggaaaauguccgagauauguuaagcaaaggagucugcugcuagcaacagggaugaagaauguuccugagauuccaaagggaagaggccuauuuggugcuauagcggguuucauugaaaauggaugggaaggccuaauugaugguugguaugguuucagacaccagaaugcacagggagagggaacugcugcagauuacaaaagcacucaaucggcaauugaucaaauaacaggaaaauuaaaccggcuuauagaaaaaaccaaccaacaauuugaguugauagacaaugaauucaaugagguagagaagcaaaucgguaaugugauaaauuggaccagagauucuauaacagaaguguggucauacaaugcugaacucuugguagcaauggagaaccagcauacaauugaucuggcugauucagaaauggacaaacuguacgaacgagugaaaagacagcugagagagaaugcugaagaagauggcacugguugcuuugaaauauuucacaagugugaugaugacuguauggccaguauuagaaauaacaccuaugaucacagcaaauacagggaagaggcaaugcaaaauagaauacagauugacccagucaaacuaagcagcggcuacaaagaugugauacuuugguuuagcuucggggcaucauguuucauacuucuagccauuguaaugggccuugucuucauauguguaaagaauggaaacaugcggugcacuauuuguauauaa

SEQ ID NO: 41474 - RNA, 1698 nt, Artificial Sequence; identical to SEQ ID NO: 38297
  hemagglutinin__InfluenzaA__AHG96108

SEQ ID NO: 41475 - RNA, 1698 nt, Artificial Sequence; identical to SEQ ID NO: 38297
  hemagglutinin__InfluenzaA__AHG96120

SEQ ID NO: 41476 - RNA, 1698 nt, Artificial Sequence; identical to SEQ ID NO: 38297
  hemagglutinin__InfluenzaA__AHG96132

SEQ ID NO: 41477 - RNA, 1698 nt, Artificial Sequence
  hemagglutinin__InfluenzaA__AHG96144
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauagguguccaaaaggcccucuaucauacagaaaaugcuuaugucucuguagugucuucacauuauagcagaaaauucaccccagaaauagccaaaagacccaaaguaagagaucaagaaggaagaaucaauuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuuacaguguagaauaugcaucuaa

SEQ ID NO: 41478 - RNA, 1698 nt, Artificial Sequence; identical to SEQ ID NO: 38297
  hemagglutinin__InfluenzaA__AHG96156

SEQ ID NO: 41479 - RNA, 1698 nt, Artificial Sequence; identical to SEQ ID NO: 38297
  hemagglutinin__InfluenzaA__AHG96168

SEQ ID NO: 41480 - RNA, 1698 nt, Artificial Sequence; identical to SEQ ID NO: 38297
  hemagglutinin__InfluenzaA__AHG96180

SEQ ID NO: 41481 - RNA, 1698 nt, Artificial Sequence; identical to SEQ ID NO: 38297
  hemagglutinin__InfluenzaA__AHG96192

SEQ ID NO: 41482 - RNA, 1698 nt, Artificial Sequence; identical to SEQ ID NO: 38297
  hemagglutinin__InfluenzaA__AHG96204

SEQ ID NO: 41483 - RNA, 1698 nt, Artificial Sequence; identical to SEQ ID NO: 38297
  hemagglutinin__InfluenzaA__AHG96216

SEQ ID NO: 41484 - RNA, 1698 nt, Artificial Sequence
  hemagglutinin__InfluenzaA__AHG96228
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccuaagcaaguccuaugcaaacaacaaagaaaaagaaguccuuguacuaugggguguucaucacccgccaaacauagguaaccaaaaggcccucuaucauacagaaaaugcuuaugucucuguagugucuucacauuauagcagaaaauucaccccagaaauagccaaaagacccaaaguaagagaucaagaaggaagaaucaauuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuuacaguguagaauaugcaucuaa

SEQ ID NO: 41485 - RNA, 1698 nt, Artificial Sequence; identical to SEQ ID NO: 41477
  hemagglutinin__InfluenzaA__AHG96240

SEQ ID NO: 41486 - RNA, 1698 nt, Artificial Sequence; identical to SEQ ID NO: 38297
  hemagglutinin__InfluenzaA__AHG96252

SEQ ID NO: 41487 - RNA, 1698 nt, Artificial Sequence; identical to SEQ ID NO: 38297
  hemagglutinin__InfluenzaA__AHG96264

SEQ ID NO: 41488 - RNA, 1698 nt, Artificial Sequence; identical to SEQ ID NO: 38297
  hemagglutinin__InfluenzaA__AHG96276

SEQ ID NO: 41489 - RNA, 1698 nt, Artificial Sequence; identical to SEQ ID NO: 38297
  hemagglutinin__InfluenzaA__AHG96288

SEQ ID NO: 41490 - RNA, 1698 nt, Artificial Sequence; identical to SEQ ID NO: 38297
  hemagglutinin__InfluenzaA__AHG96300

SEQ ID NO: 41491 - RNA, 1701 nt, Artificial Sequence
  hemagglutinin__InfluenzaA__AHG96312
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagucccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaagggaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcuaaauuaaacagagaaaaaauagaugggguaaaacuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 41492 - RNA, 1701 nt, Artificial Sequence
  hemagglutinin__InfluenzaA__AHG96313
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaccagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuuuauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 41493 - RNA, 1701 nt, Artificial Sequence
  hemagglutinin__InfluenzaA__AHG96314
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacacuagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguacacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 41494 - RNA, 1701 nt, Artificial Sequence
  hemagglutinin__InfluenzaA__AHG96315
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 41495 - RNA, 1701 nt, Artificial Sequence
  hemagglutinin__InfluenzaA__AHG96316
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauagccggcuucauugaaggaggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 41496 - RNA, 1701 nt, Artificial Sequence
  hemagglutinin__InfluenzaA__AHG96317
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucuuuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaauaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 41497 - RNA, 1701 nt, Artificial Sequence
  hemagglutinin__InfluenzaA__AHG96320
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 41498 - RNA, 1701 nt, Artificial Sequence
  hemagglutinin__InfluenzaA__AHG96321
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggcaacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccaccuggaaaaaagaauagagaauuuaaauaaaaaaguugaugauggcuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 41499 - RNA, 1701 nt, Artificial Sequence
  hemagglutinin__InfluenzaA__AHG96322
augaaggcaauacuaguaguucugcuauauacauuugcaaccgcaaaugcagacacauuauguauagguuaucaugcaaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaaaacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaacucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccaugauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauuggugcugguagucucccugggggcaaucagcuucuggaugugcucuaaugggucucuacaguguagaauauguauuuaa

SEQ ID NO: 41500 - RNA, 1701 nt, Artificial Sequence; identical to SEQ ID NO: 41497
  hemagglutinin__InfluenzaA__AHG96324

SEQ ID NO: 41501 - RNA, 1701 nt, Artificial Sequence
  hemagglutinin__InfluenzaA__AHG96325
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaacgagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaaaaaauagaugggguaaaguuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 41502 - RNA, 1701 nt, Artificial Sequence
  hemagglutinin__InfluenzaA__AHG96326
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaauucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaggaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 41503 - RNA, 1701 nt, Artificial Sequence; identical to SEQ ID NO: 41497
  hemagglutinin__InfluenzaA__AHG96327

SEQ ID NO: 41504 - RNA, 1701 nt, Artificial Sequence
  hemagglutinin__InfluenzaA__AHG96329
augaaggcaauacuaguaguucugcuauauacauuuacaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuucccaagacaaguucauggcccaaucaugacucgaacaaagguguaacggcagcauguccucacgcuggagcaaaaagcuucuacaaaaauuuaauauggcuaguuaaaaaagggaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuauuauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagauaagaaaccaguuaaaaaacaaugccaaggaaauuggaaacggcugcuuugaauuuuaccacaaaugcgauaacacgugcauggaaagugucaaaaaugggacuuaugaauacccaaaauacucagaggaagcaaaauuaaacagagaaaaaauagaugguguaaagcuggaaucaacaaagauuuaccagauuuuggcgaucuauucaacugucgccaguucauugguacugguagucucccugggggcaaucagcuucuggaugugcucuaaugggucucuacaguguagaauauguauuuaa

SEQ ID NO: 41505 - RNA, 1701 nt, Artificial Sequence
  hemagglutinin__InfluenzaA__AHG96330
augaaggcaauacuaguaguucugcuauauacauuugcaaccgcaacugcagacacauuauguauagguuaucaugcaaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaaaacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagucuggccacaggauugaggaaugucccgucuauucaaucuagaggccuauucggggccauugccggcuucauugaagggggauggacagggaugguagauggaugguacgguuaucaccaucaaaaugagcaggggucaggauaugcagccgaccugaagagcacacaaaaugccauugacaagauuacuaacaaaguaaacucuguuauugaaaagaugaauacacaguucacagcaguggguaaagaguucaaccaccuggaaaaaagaauagagaauuuaaauaaaaaaguugaugaugguuuccuggacauuuggacuuacaaugcugaacuguugguucuauuggaaaaugaaagaacuuuggacuaccacgauucaaaugugaagaacuuguaugaaaagauaagaaaccaguuaaaaaacaaugccaaggaaauuggaaacggcugcuuugaauuuuaccacaaaugugauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 41506 - RNA, 1701 nt, Artificial Sequence
  hemagglutinin__InfluenzaA__AHG96332
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 41507 - RNA, 1701 nt, Artificial Sequence
  hemagglutinin__InfluenzaA__AHG96334
augaaggcaauacuaguaguucugcuauauacacuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacggcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaaacuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 41508 - RNA, 1701 nt, Artificial Sequence
  hemagglutinin__InfluenzaA__AHG96335
augaaggcaauacuaguaguucugcuauauacauuugaaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaaaagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 41509 - RNA, 1701 nt, Artificial Sequence
  hemagglutinin__InfluenzaA__AHG96336
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccgcgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 41510 - RNA, 1701 nt, Artificial Sequence
  hemagglutinin__InfluenzaA__AHG96338
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaacugagcucagugucaucauuugaaagguuugagauauuccccaagacaaguucauggcccaaucaugacucgaacaaagguguaacggcagcauguucucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 41511 - RNA, 1701 nt, Artificial Sequence
  hemagglutinin__InfluenzaA__AHG96339
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaauccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggcuugaggaaugucccgucuauucaaucuagaggccuauucggggccauugccggcuucauugaaggaggguggacagggaugguagauggaugguacgguuaucaccaucaaaacgagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 41512 - RNA, 1701 nt, Artificial Sequence
  hemagglutinin__InfluenzaA__AHG96340
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagggagcaauugagcucagugucaucauuugaaagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 41513 - RNA, 1701 nt, Artificial Sequence
  hemagglutinin__InfluenzaA__AHG96341
augaaggcaauacuaguaguucugcuauauacauuugcaaccgcaaaugcagacacuuuauguauagguuaucaugcgaacaauucaacagacacuguagacacaguacuagaaaagaauguaacaguaacacacucuguuaaccuucuagaagacaagcauaacgguaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagucaauccuacauuaaugauaaagggaaagaaguccucgugcuguggggcauucaccauccaucuacuacugcugaccaacaaagucucuaucagaaugcagaugcauauguuuuuguggggacaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggcaacaggauugaggaauaucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaacucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 41514 - RNA, 1701 nt, Artificial Sequence
  hemagglutinin__InfluenzaA__AHG96342
augaaggcaauacuaguaguucugcuauauacauuugcaaccgcaaaugcagacacuuuauguauagguuaucaugcgaacaauucaacagacacuguagacacaguacuagaaaagaauguaacaguaacacacucuguuaaccuucuagaagacaagcauaacgguaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugauucgaacaaagguguaacggcagcauguccucacgcuggagcaaaaagcuucuacaaaaauuuaauauggcuaguuaaaaaaggaaauucauacccaaagcucagucaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggcaacaggauugaggaauaucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaacucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguuuuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacaugugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaauguagaauauguauuuaa

SEQ ID NO: 41515 - RNA, 1701 nt, Artificial Sequence
  hemagglutinin__InfluenzaA__AHG96343
augaaggcaauacuaguaguccugcuauauacauuugcaaccgcaacugcagacacauuauguauagguuaucaugcaaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaauucagacaauggaacguguuacccaggagauuucaucaauuaugaggagcuaagagagcaauugagcucagugucaucauuugaaagguuugagauauuccccaaaacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucucgugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaacucuguuauugaaaagaugaauacacaguucacagcaguggguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 41516 - RNA, 1701 nt, Artificial Sequence
  hemagglutinin__InfluenzaA__AHG96344
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaacgagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaauggaacuuaugacuacccaaaauacucagaggaagcaaaauuaaacagagaaaaaauagauggaguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 41517 - RNA, 1701 nt, Artificial Sequence
  hemagglutinin__InfluenzaA__AHG96345
augaaggcaauacuaguaguucugcuauauacacuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacggcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagagaucaagaagggagaaugaacuacuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaaacuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 41518 - RNA, 1701 nt, Artificial Sequence
  hemagglutinin__InfluenzaA__AHG96346
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaaacuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 41519 - RNA, 1701 nt, Artificial Sequence
  hemagglutinin__InfluenzaA__AHG96347
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaaacuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 41520 - RNA, 1701 nt, Artificial Sequence; identical to SEQ ID NO: 41494
  hemagglutinin__InfluenzaA__AHG96348

SEQ ID NO: 41521 - RNA, 1701 nt, Artificial Sequence
  hemagglutinin__InfluenzaA__AHG96349
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacauccaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaacgagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 41522 - RNA, 1701 nt, Artificial Sequence
  hemagglutinin__InfluenzaA__AHG96350
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaagagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaaacuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 41523 - RNA, 1701 nt, Artificial Sequence
  hemagglutinin__InfluenzaA__AHG96351
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 41524 - RNA, 1701 nt, Artificial Sequence
  hemagglutinin__InfluenzaA__AHG96352
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 41525 - RNA, 1701 nt, Artificial Sequence
  hemagglutinin__InfluenzaA__AHG96353
augaaggcaauacuaguaguucugcuauauacauuugcaaccacaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugcaaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 41526 - RNA, 1701 nt, Artificial Sequence
  hemagglutinin__InfluenzaA__AHG96354
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaggcaaaauuaaacagagaaaaaauagaugggguaaaacuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 41527 - RNA, 1701 nt, Artificial Sequence
  hemagglutinin__InfluenzaA__AHG96355
augaaggcaauacuaguaguucugcuauauacacuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacuauccacggcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccagcuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaaacuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 41528 - RNA, 1701 nt, Artificial Sequence
  hemagglutinin__InfluenzaA__AHG96356
augaagacuaucauugcuuugagcuacauucuauguuugguuuucgcucaaaaacuuccuggaaaugacaauagcacggcaacgcugugccuugggcaccaugcaguaccaaauggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauuaaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaacuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41529 - RNA, 1701 nt, Artificial Sequence
  hemagglutinin__InfluenzaA__AHG96359
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacgaugaaagcuucaauuggacuggagucacucaaaauggaacaagcucuucuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccgguuacggacaaugaccaaaucuuccuguaugcucaagcaucaggaagaaucacagucucuaccaaaagaagccaacaaacuguaaucccgaauaucggaucuagacccagaauaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41530 - RNA, 1701 nt, Artificial Sequence; identical to SEQ ID NO: 41529
  hemagglutinin__InfluenzaA__AHG96371

SEQ ID NO: 41531 - RNA, 1701 nt, Artificial Sequence; identical to SEQ ID NO: 41529
  hemagglutinin__InfluenzaA__AHG96383

SEQ ID NO: 41532 - RNA, 1698 nt, Artificial Sequence; identical to SEQ ID NO: 38297
  hemagglutinin__InfluenzaA__AHG96395

SEQ ID NO: 41533 - RNA, 1701 nt, Artificial Sequence; identical to SEQ ID NO: 41529
  hemagglutinin__InfluenzaA__AHG96407

SEQ ID NO: 41534 - RNA, 1701 nt, Artificial Sequence; identical to SEQ ID NO: 41529
  hemagglutinin__InfluenzaA__AHG96419

SEQ ID NO: 41535 - RNA, 1701 nt, Artificial Sequence; identical to SEQ ID NO: 41529
  hemagglutinin__InfluenzaA__AHG96431

SEQ ID NO: 41536 - RNA, 1701 nt, Artificial Sequence; identical to SEQ ID NO: 41529
  hemagglutinin__InfluenzaA__AHG96443

SEQ ID NO: 41537 - RNA, 1701 nt, Artificial Sequence; identical to SEQ ID NO: 41529
  hemagglutinin__InfluenzaA__AHG96455

SEQ ID NO: 41538 - RNA, 1701 nt, Artificial Sequence; identical to SEQ ID NO: 41529
  hemagglutinin__InfluenzaA__AHG96467

SEQ ID NO: 41539 - RNA, 1701 nt, Artificial Sequence; identical to SEQ ID NO: 41529
  hemagglutinin__InfluenzaA__AHG96479

SEQ ID NO: 41540 - RNA, 1701 nt, Artificial Sequence; identical to SEQ ID NO: 41529
  hemagglutinin__InfluenzaA__AHG96491

SEQ ID NO: 41541 - RNA, 1701 nt, Artificial Sequence; identical to SEQ ID NO: 32860
  hemagglutinin__InfluenzaA__AHG96503

SEQ ID NO: 41542 - RNA, 1698 nt, Artificial Sequence; identical to SEQ ID NO: 38297
  hemagglutinin__InfluenzaA__AHG96515

SEQ ID NO: 41543 - RNA, 1698 nt, Artificial Sequence; identical to SEQ ID NO: 38297
  hemagglutinin__InfluenzaA__AHG96527

SEQ ID NO: 41544 - RNA, 1698 nt, Artificial Sequence; identical to SEQ ID NO: 38297
  hemagglutinin__InfluenzaA__AHG96539

SEQ ID NO: 41545 - RNA, 1698 nt, Artificial Sequence; identical to SEQ ID NO: 38297
  hemagglutinin__InfluenzaA__AHG96551

SEQ ID NO: 41546 - RNA, 1698 nt, Artificial Sequence; identical to SEQ ID NO: 41477
  hemagglutinin__InfluenzaA__AHG96563

SEQ ID NO: 41547 - RNA, 1698 nt, Artificial Sequence; identical to SEQ ID NO: 38297
  hemagglutinin__InfluenzaA__AHG96575

SEQ ID NO: 41548 - RNA, 1698 nt, Artificial Sequence; identical to SEQ ID NO: 38297
  hemagglutinin__InfluenzaA__AHG96587

SEQ ID NO: 41549 - RNA, 1698 nt, Artificial Sequence; identical to SEQ ID NO: 38297
  hemagglutinin__InfluenzaA__AHG96599

SEQ ID NO: 41550 - RNA, 1698 nt, Artificial Sequence; identical to SEQ ID NO: 38297
  hemagglutinin__InfluenzaA__AHG96611

SEQ ID NO: 41551 - RNA, 1698 nt, Artificial Sequence; identical to SEQ ID NO: 38297
  hemagglutinin__InfluenzaA__AHG96623

SEQ ID NO: 41552 - RNA, 1698 nt, Artificial Sequence; identical to SEQ ID NO: 38297
  hemagglutinin__InfluenzaA__AHG96635

SEQ ID NO: 41553 - RNA, 1698 nt, Artificial Sequence; identical to SEQ ID NO: 38297
  hemagglutinin__InfluenzaA__AHG96647

SEQ ID NO: 41554 - RNA, 1698 nt, Artificial Sequence; identical to SEQ ID NO: 38297
  hemagglutinin__InfluenzaA__AHG96659

SEQ ID NO: 41555 - RNA, 1698 nt, Artificial Sequence; identical to SEQ ID NO: 38297
  hemagglutinin__InfluenzaA__AHG96671

SEQ ID NO: 41556 - RNA, 1698 nt, Artificial Sequence; identical to SEQ ID NO: 38297
  hemagglutinin__InfluenzaA__AHG96683

SEQ ID NO: 41557 - RNA, 1701 nt, Artificial Sequence; identical to SEQ ID NO: 41529
  hemagglutinin__InfluenzaA__AHG96695

SEQ ID NO: 41558 - RNA, 1701 nt, Artificial Sequence; identical to SEQ ID NO: 41529
  hemagglutinin__InfluenzaA__AHG96707

SEQ ID NO: 41559 - RNA, 1701 nt, Artificial Sequence; identical to SEQ ID NO: 41529
  hemagglutinin__InfluenzaA__AHG96719

SEQ ID NO: 41560 - RNA, 1701 nt, Artificial Sequence; identical to SEQ ID NO: 41529
  hemagglutinin__InfluenzaA__AHG96731

SEQ ID NO: 41561 - RNA, 1701 nt, Artificial Sequence; identical to SEQ ID NO: 41529
  hemagglutinin__InfluenzaA__AHG96743

SEQ ID NO: 41562 - RNA, 1701 nt, Artificial Sequence; identical to SEQ ID NO: 41529
  hemagglutinin__InfluenzaA__AHG96755

SEQ ID NO: 41563 - RNA, 1701 nt, Artificial Sequence; identical to SEQ ID NO: 41529
  hemagglutinin__InfluenzaA__AHG96767

SEQ ID NO: 41564 - RNA, 1701 nt, Artificial Sequence; identical to SEQ ID NO: 41529
  hemagglutinin__InfluenzaA__AHG96779

SEQ ID NO: 41565 - RNA, 1701 nt, Artificial Sequence
  hemagglutinin__InfluenzaA__AHG96791
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacgaugaaagcuucaauuggacuggagucacucaaaauggaacaagcucuucuugcaaaaggagaucuaauaacaguuucuuuaguagauugaauugguugacccaauuaaaauucaaauacccagcauugaacgugacuaugccaaacaaugaaaaauuugacaaauuguacauuugggggguucaccacccgguuacggacaaugaccaaaucuuccuguaugcucaagcaucaggaagaaucacagucucuaccaaaagaagccaacaaacuguaaucccgaauaucggaucuagacccagaauaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaaaggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41566 - RNA, 1701 nt, Artificial Sequence; identical to SEQ ID NO: 41529
  hemagglutinin__InfluenzaA__AHG96803

SEQ ID NO: 41567 - RNA, 1701 nt, Artificial Sequence; identical to SEQ ID NO: 41529
  hemagglutinin__InfluenzaA__AHG96815

SEQ ID NO: 41568 - RNA, 1701 nt, Artificial Sequence; identical to SEQ ID NO: 41529
  hemagglutinin__InfluenzaA__AHG96827

SEQ ID NO: 41569 - RNA, 1701 nt, Artificial Sequence; identical to SEQ ID NO: 41529
  hemagglutinin__InfluenzaA__AHG96839

SEQ ID NO: 41570 - RNA, 1701 nt, Artificial Sequence; identical to SEQ ID NO: 41529
  hemagglutinin__InfluenzaA__AHG96851

SEQ ID NO: 41571 - RNA, 1701 nt, Artificial Sequence; identical to SEQ ID NO: 41529
  hemagglutinin__InfluenzaA__AHG96863

SEQ ID NO: 41572 - RNA, 1701 nt, Artificial Sequence; identical to SEQ ID NO: 41529
  hemagglutinin__InfluenzaA__AHG96875

SEQ ID NO: 41573 - RNA, 1701 nt, Artificial Sequence; identical to SEQ ID NO: 41529
  hemagglutinin__InfluenzaA__AHG96887

SEQ ID NO: 41574 - RNA, 1701 nt, Artificial Sequence; identical to SEQ ID NO: 41529
  hemagglutinin__InfluenzaA__AHG96899

SEQ ID NO: 41575 - RNA, 1701 nt, Artificial Sequence; identical to SEQ ID NO: 41529
  hemagglutinin__InfluenzaA__AHG96911

SEQ ID NO: 41576 - RNA, 1701 nt, Artificial Sequence; identical to SEQ ID NO: 41529
  hemagglutinin__InfluenzaA__AHG96923

SEQ ID NO: 41577 - RNA, 1701 nt, Artificial Sequence; identical to SEQ ID NO: 41529
  hemagglutinin__InfluenzaA__AHG96935

SEQ ID NO: 41578 - RNA, 1701 nt, Artificial Sequence; identical to SEQ ID NO: 41529
  hemagglutinin__InfluenzaA__AHG96947

SEQ ID NO: 41579 - RNA, 1701 nt, Artificial Sequence; identical to SEQ ID NO: 41529
  hemagglutinin__InfluenzaA__AHG96959

SEQ ID NO: 41580 - RNA, 1701 nt, Artificial Sequence; identical to SEQ ID NO: 41529
  hemagglutinin__InfluenzaA__AHG96971

SEQ ID NO: 41581 - RNA, 1701 nt, Artificial Sequence; identical to SEQ ID NO: 41529
  hemagglutinin__InfluenzaA__AHG96983

SEQ ID NO: 41582 - RNA, 1701 nt, Artificial Sequence; identical to SEQ ID NO: 41529
  hemagglutinin__InfluenzaA__AHG96995

SEQ ID NO: 41583 - RNA, 1701 nt, Artificial Sequence; identical to SEQ ID NO: 41529
  hemagglutinin__InfluenzaA__AHG97007

SEQ ID NO: 41584 - RNA, 1701 nt, Artificial Sequence; identical to SEQ ID NO: 41529
  hemagglutinin__InfluenzaA__AHG97019

SEQ ID NO: 41585 - RNA, 1701 nt, Artificial Sequence; identical to SEQ ID NO: 41529
  hemagglutinin__InfluenzaA__AHG97031

SEQ ID NO: 41586 - RNA, 1701 nt, Artificial Sequence; identical to SEQ ID NO: 41529
  hemagglutinin__InfluenzaA__AHG97043

SEQ ID NO: 41587 - RNA, 1701 nt, Artificial Sequence
  hemagglutinin__InfluenzaA__AHH00866
augaagacuaucauugcuuugagcuacauuuuaugucuggcuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacugauagaugcucuauugggagacccacauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcucugcuugcaaaaggagaucuauuaaaaguuucuuuaguagauugaauugguugcaccaauuagaaaacagauauccagcacugaacgugacuaugccaaacaaugacaaauuugacaaauuguacauuugggggguucaccacccgaguacggacagugaccaaaucagcguauaugcccaagcaucagggagagucacagucucuaccaaaagaagccaacaaacuguaaucccgaauaucggauccagacccuggguaagggguaucuccagcagaauaagcaucuauuggacaauaguaaacccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugauggacgguugguacgguuucaggcaucaaaauucugagggcacaggacaagcagcagaucuuaaaagcacucaagcagcaaucaaccaaaucaacgggaaacugaauaaguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagagaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucauuaugugggccugccaaaaaggcaacauuaggugcaacauuugcauuuga

SEQ ID NO: 41588 - RNA, 1701 nt, Artificial Sequence
  hemagglutinin__InfluenzaA__AHH00870
augaagacuaucauugcuuugagcuacauuuuaugucuggcuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacugauagaugcucuauugggagacccacauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcucugcuugcaaaaggagaucuauuaaaaguuucuuuaguagauugaauugguugcaccaauuagaaaacagauauccagcacugaacgugacuaugccaaacaaugacaaauuugacaaauuguacauuugggggguucaccacccgaguacggacagugaccaaaucagcguauaugcccaagcaucagggagagucacagucucuaccaaaagaagccaacaaacuguaaucccgaauaucggauccagacccuggguaagggguaucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugauggacgguugguacgguuucaggcaucaaaauucugagggcacaggacaagcagcagaucuuaaaagcacucaagcagcaaucaaccaaaucaacgggaaacugaauaaguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagagaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucauuaugugggccugccaaaaaggcaacauuaggugcaacauuugcauuuga

SEQ ID NO: 41589 - RNA, 1701 nt, Artificial Sequence
  hemagglutinin__InfluenzaA__AHJ57430
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcagacuaagagggguagccccauugcauuuggguaaauguaacauugcuggcuggauccugggaaauccagagugugaaucacucuccacagcgaguucaugguccuacauuguggaaacaucuaguucagacaauggaacguguuacccaggagauuucaucaauuaugaggagcuaagagagcaauugagcucagugucaucauuugaaagguuugagauaucccccaagacaaguucauggcccaaucaugacucgaacaaagguguaagggcagcauguccucaugcuggagcaaaaagcuucuacaaaaauuuaauauggcuaguuaaaaaaggaaauucauacccaaagcucagcaaauccuacauuaaugauaaagggaaagaaguccuggugcuauggggcauucaccauccaucuacuagugcugaccaacaaagucucuaucagaaugcagaugcauauguuuuuguggggacaucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauacgcauucgcaauggaaagaaaugcugcaucugguauuaucauuucagauacaccaguccacgauugcaauacaacuugucagacacccaagggugcuguaaacaccagccucccauuucagaauauacauccgaucacaauuggaaaauguccaaaauauguaaaaagcacaaaauugagacuggccacaggauugaggaauaucccgucuauucaaucuagaggccuauucggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcaauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 41590 - RNA, 1701 nt, Artificial Sequence
  hemagglutinin__InfluenzaA__AHJ57431
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaagggcagcauguccucaugcuggagcaaaaagcuucuacaaaaauuuaauauggcuaguuaaaaaaggaaauucauacccaaagcucagccaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaauaucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 41591 - RNA, 1701 nt, Artificial Sequence
  hemagglutinin__InfluenzaA__AHJ57432
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccgcaaauagcaauaagacccaaagugagggaucaagaagggagaaugaacuauuacuggacacuaguagagccaggagacaaaauaacauucgaagcaacuggaaaucuagugguaccgagauaugcauucgcauuggaaagaaaugcuggaucugguauuaucauuucagauacaccaguacacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauucggggccauugccgguuucauugaagggggguggacagggaugguagagggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 41592 - RNA, 1701 nt, Artificial Sequence
  hemagglutinin__InfluenzaA__AHJ57433
augaaggcaauacuaguaguucugcuauauacauuugcaaccgcaaaugcagacacauuauguauagguuaucaugcgaacaauucaacagacacuguagacacaguacuagaaaagaauguaacaguaacacacuccguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaagaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaauagagccaggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 41593 - RNA, 1701 nt, Artificial Sequence
  hemagglutinin__InfluenzaA__AHJ57434
augaaggcaauacuaguaguucugcuauauacauuugcaaccgcaaaugcagacacauuauguauagguuaucaugcgaacaauucaacagacacuguagacacaguacuagaaaagaauguaacaguuacacacucuguuaacccucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaagaaggaaauucauacccaaagcucagcaaauccuacauuaaugauaaagggaaagaaguccucgugcuauggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 41594 - RNA, 1701 nt, Artificial Sequence
  hemagglutinin__InfluenzaA__AHJ57435
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacagagguguaacggcagcauguccucaugcuggagcaaaaagcuucuacaaaaauuuaauauggcuaguuaaaaaaggaaauucauaccccaagcucagccaauccuacauuaaugauaaagggaaagaaguucucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaagauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 41595 - RNA, 1701 nt, Artificial Sequence
  hemagglutinin__InfluenzaA__AHJ57436
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccucaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaucccaaacaaugaacaauuugacaaauuguacauuugggggguucaccacccggguacggacaaggaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaguuccaucagauugaaaaagaauucucagaaguagaagggagaauucaggaccuugagaaauauguugaggacacuaaaauagaucucuggucauacaacgcggagcuucuuguugcccuggagaaccaacauacaaucgaucuaacugacucagaauugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41596 - RNA, 1701 nt, Artificial Sequence
  hemagglutinin__InfluenzaA__AHJ57437
augaagacuaucauugcuuugagcuacauucuaugucugguuuucgcucaaaaacuuccuggaaaugacaacagcacggcaacgcugugccuugggcaccaugcaguaccaaacggaacaauagugaaaacaaucacgaaugaccaaauugaaguuacuaaugcuacugagcugguucagaauuccucaacaggugaaauaugcgacaguccucaucagauccuugauggagaaaacugcacacuaauagaugcucuauugggggacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaagaccaaaucuuccuguaugcucaaucaucaggaagaaucacaguaucuaccaaaagaagccaacaaaccguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugaaggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41597 - RNA, 1701 nt, Artificial Sequence
  hemagglutinin__InfluenzaA__AHJ57438
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucaucgggcacacuggaguuuaacaaugaaagcuucaauuggacuggagucacucaaaacggaacaaguucugcuugcauaaggagaucuaauaguaguuucuuuaguagauugaaaugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggacugucccagauauguuaagcaaagcacucugaaauuggcaacaggaaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcacaggaucaaucagaaauggaacuuaugaccacgauguauacagagaugaagcauuaaacaaccgguuucagaucaagggaguugaggugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41598 - RNA, 1701 nt, Artificial Sequence
  hemagglutinin__InfluenzaA__AHJ57651
augauugcauucauuguaauagcaauacuggcagcaaccggaaaaucagacaagauaugcauuggauaucaugccaacaauucaacaacaaagguagauacuauacucgagaagaacguaaccgucacacacucaguugagcugcuggagaaccagaaagaagaaagauucugcaaaaucucaaacaaggccccucucgaucuaagggauuguacccuagaggguuggaucuuggggaauccccgaugcggcauauugcuugcugaccaaagcuggucauacauaguggaacggccuaaugcccgaaaugggauuugcuauccuggaacauugaaugaaguugaagaauugaaggcacuuauuggaucaggggaaaggguagaaagguuugagauguuucccaaaagcacaugggcaggaguggacaccgacaguggagugucaagugcuuguccucuugguaauggcccaucuuucuacaggaaucuucuauggauaauaaaacuaaagucaucagaauacccaguaauuagaggaacuuucaacaacacuggagacaagucaauucucuauuuuugggguguacaccauccuccugucacaacugaacaagaagcucuguaugguucuggugaucgauacguuagaaugggaacugaaagcaugaauuuugccaggaguccagaaauugcggcaaggccugcugugaauggucagagaggcagaaucgauuauuucugguccaucuuaaaaccaggggaaaccuugaauguagaaucuaaugggaauuugauagccccuugguaugcauacagauuugucaacaaagauaguaaaggagccauauucagaucuacuuuaccaauugagaacugugaugccacaugccagacuacugaaggagugauaagaaccaacaaaacauuucagaaugugagcccucuguggauuggagaaugccccaaguauguaaaaaguaagagucuaagacuugcaacuggacuaaggaauguuccacaaauagaaacuagaggacuuuuuggagcuauugcgggcuucauugaaggaggauggacuggaaugauugauggaugguauggcuaccaucaugaaaauucucaaggcucaggauaugcagcugauagagaaagcacucaaaaggcuauagacggaauuacaaacaaggucaauuccaucauugauaaaaugaacacacaauuugaggcuguaggucaugaguucucaaaccuggagagaaggauugacaaccuaaacaaaagaauggaagauggauuucuggauguuuggacauacaacgcugaauuauuaguucuccuugaaaacgaaagaacacuggacaugcaugaugcgaaugugaaaauucuguaugaaaaggucagaucacaacuacgagacaaugcuaaagaccuaggaaaugggugcuuugaauuuuggcauaagugugacaaugaaugcauagagucugucaagaauggcacuuauaacuaucccaaauaccaaagugaaagcagauuaaacaggcaaacaauagaaucagugaagcuggaaaaucuugguguguaucaaauucuugcuauuuauaguacgguaucgagcagucuaguuuugguagggcugaucuuggcaaugggucuuuggauguguucaaaugguucaaugcaaugcaggauauguauauaa

SEQ ID NO: 41599 - RNA, 1701 nt, Artificial Sequence
  hemagglutinin__InfluenzaA__AHJ57663
augauugcauucauuguaauagcaacacugguagcaaccggaaaaucagacaagauaugcauuggauaucaugcaaacaauucgacaacaaagguagauacgauacuugagaagaacguaacugucacacacucaguugaacugcuggagaaccagaaagaagaaagauucugcaagaucucaaacaaggccccucucgaucuaagggauuguacccuagaggguuggaucuuggggaacccccgaugcggcauauugcuagcugaccaaagcuggucauacauaguagaacggccuaaugcccgaaaugggauuugcuauccuggaacauugaaugaagcagaagaauuaaaggcacuuauuggaucaggagaaaggguagaaagguuugagauguuucccaaaagcacauggacaggaguggacaccgaaaguggaguaucaagugcuuguccucuugguaaugguccaucuuucuacaggaaucuucuauggauaauaaaacucaagucaucagaauacccaguaaucagaggaacuuucaacaacacuggagacaagucaauucucuauuuuugggguguacaccauccuccugucacaacugaacaaaaugcucuguaugguucuggugaucgauauguuagaaugggaacugaaagcaugaauuuugccaggagcccagaaauugcggcaagaccugcugugaauggucagagaggcaggauugauuauuucugguccaucuuaaaaccaggagaaaccuugaauguagaaucuaaugggaauuuaauagccccuugguaugcauacagauuugucaacaaagauagcaaaggggccauauucagaucuaauuuaccaaucgagaacugugaugccacaugccagacuacugaaggagugauaagaaccaacaaaacauuucagaaugugagcccucuguggauuggagaaugccccaaguauguaaaaaguaaaagucuaaggcuugcuacuggacuaaggaauguuccacaaauagaaacuagaggacuuuuuggagcuauugcaggcuucauugaaggaggguggacuggaaugauugaugggugguacggcuaccaucaugaaaauucucaaggcucaggauaugcagcugauaaagaaagcacucaaaaggccauagacggaaucacaaacaaggucaauuccaucauugauaaaaugaauacacaauuugaggcuguaggucaugaguuuucaaaccuggagagaaggauugacaaccuaaacaaaagaauggaagauggauuccuggauguuuggacauacaacgcugaacugcugguucuucuugaaaacgaaagaacacuagaccuacaugaugcaaaugugaagaaccuacaugaaagggucaaaucacaacugagggacaaugcuaaugaccuagggaacggaugcuuugaauuuuggcauaagugugacaaugaauguauggagucugucaaaaaugguaccuauaacuaucccaaguaucaagcugagaguagauuaaacaaacagaaaauagaaucgguaaaacuggaggaguuugguguguaucaaauccuugccauuuauaguacgguaucgagcagucuaguuuugguagggcugaucauggcaaugggucuuuggauguguccaaaugguucaaugcagugcaggauauguauauaa

SEQ ID NO: 41600 - RNA, 1701 nt, Artificial Sequence
  hemagglutinin__InfluenzaA__AHJ57674
augauugcauucauuguaauagcgauacugguaacaaccggaaaaucagacaagauaugcauuggauaucaugcuaacaauucaacaacgaagguagauacuauacucgagaagaacguaaccgucacacacucaguugaacugcuggagaaccagaaagaagaaagauucugcaaaaucucgaacaaggccccucucgaucuaagggauuguacccuagaggguuggaucuuggggaauccccgaugcggcauauugcucgcugaccaaagcuggucauacauaguggaaaggccuaaugcccgaaaugggauuugcuauccuggaacauugaaugaaguagaagaauugaaggcacuuauuggaucaggggaaagaguagaaagauuugagauguuucccaaaaguacaugggcaggaguggacaccaauaguggaguaucaagugcuuguccucuuggugaggguccaucuuucuacaggaaucuucuauggauaauaaaacacacgacaucaggauauccaguaauuaaaggaacuuacagaaacacuggagauaagucaguucuuuauuuuuggggugugcaccauccuccugacacaacugaacagaauguucuguacgguucugguaaucgauacguuagaaugggaacugaaagcaugaauuuugccaggagcccagaaauugcggcaaggccugcugugaauggucagagaggcagaauugauuauuucugguccauuuugaaaccaggggaaaccuugaauguagaaucuaaugggaauuuaauagccccuugguacgcauacagauuugucaacaaagauagcaaaggagccauauucagauccaauuuaccaaucgagaacugugaugccacuugccagacuacugaaggagugauaagaaccaacaaaacauuccagaaugugagcccucuguggauuggagagugccccaaguauguaaaaaguaagagucuaaggcuugcaacuggacuaaggaauguuccacaaauagagacuagaggacuauuuggagcuauugcaggcuucauugaagggggauggacuggaaugauugaugggugguauggcuaccaucaugaaaauucccaagguucaggauaugcagccgauagagaaagcacucaaaaggcuauagacggaauuacgaacaaggucaauucuaucauugauaaaaugaacacacaauuugaggcuguaggucaugaguuuucaaaccuggaaagaaggauugacaaccuaaacaaaagaauggaagauggauuucuggauguuuggacauacaacgcugaacuguugguucuucuugaaaacgaaagaacacuagaccuacaugaugcaaaugugaagaaccuacaugaaagggucagaucacaacugagggacaaugcuaaugaccuagggaacggaugcuuugaauuuuggcauaagugugacaaugaauguauggagucagucaaaaaugguaccuauaacuaucccaaguaucaagcugagaguagauuaaauagacagaaaauagaaucgguaaaacuggaggaguuuggcguguaucaaauccuugccauuuauaguacgguaucgagcagucuaguauugguagggcugaucauggcaaugggucuuuggauguguucaaaugguucaaugcagugcaggauauguauauaa

SEQ ID NO: 41601 - RNA, 1701 nt, Artificial Sequence
  hemagglutinin__InfluenzaA__AHJ57686
augauugcauucauuguaauagcaauacuggcagcaaccggaaaaucagacaagauaugcauuggauaccaugccaacaauucaacaacaaagguagauacuauacucgagaagaacguaacugucacacacucaguugagcugcuggagaaccagaaagaaggaagauucugcaaaaucucaaacaaggccccucucgaucuaagggauuguacccuagaggguuggaucuuggggaauccucgaugcggcauacugcuugcugaccaaagcuggucauacauaguggaacggccuaaugcccgaaaugggauuugcuauccuggaauauugaaugaagcugaagaauugaaggcacuuaucggaucaggggaaaggguagaaagguuugagauguuccccaaaaguacaugggcaggaguggacacuaacaguggagugucaagugcuuguccucuugguaauggcccaucuuucuacaggaaucuucuauggauaauaaaacuaaagucaucagcauauccaguaauuagaggaacuuucaacaacacuggagacaagucaauucucuauuuuuggggugugcaccauccuccugucgcaacugaacaagaagcccuguaugguucugguaaucgauacguuagaaugggaacugaaagcaugaauuuugccaggaauccagaaauugcggcaaggccugcugugaauggucagagaggcagaaucgauuauuucugguccaucuuaaaaccaggggaaaccuugaauguagaaucuaaugggaauuuaauagccccuugguaugcauacagauuugucaacaaagauaguaaaggagccauauucagaucuaauuuaccaauugagaacugugaagccacaugccagacuacugaaggagugauaagaaccaacaaaacauuucagaaugugagcccucuguggauuggagaaugccccaaguauguaaagaguaaaagucuaagacuugcaacuggacuaaggaauguuccacaaauagaaacuagaggacuuuuuggagcuauugcaggcuucauugaaggaggauggacuggaaugauugaugggugguauggcuaccaucacgaaaauucucaaggcucaggauaugcagcugauagagaaagcacucaaaaggccauagacgggauuacaaacaaggucaacucuaucauugauaaaaugaacacgcaauuugaggcuguaggccaugaguuuucaaaccuggagagaaggauugacaaccuaaacaaaagaauggaagauggauuucuggauguuuggacauacaacgcggaacuauugguucuucuugaaaacgaaagaacacuagaccuacaugaugcaaaugugaaaaaccuacaugaaaaggucagaucacaacuaagagacaaugcuaaugaccuagggaacgggugcuuugaauuuuggcauaagugugacaaugaauguauggagucugucaagaaugguacuuaugacuaucccaaguaccaagcggagaguagguuaaacagacagaaaauagaaucgguaaaacuggagaacuuugauguguaucaaauccuugccauuuauaguacgguaucgagcagucuaguuuugguaggacugaucauggcaaugggucuuuggauguguucaaaugguucaaugcagugcaggauauguauauaa

SEQ ID NO: 41602 - RNA, 1701 nt, Artificial Sequence
  hemagglutinin__InfluenzaA__AHJ57697
augauugcauucauuguaauagcaauacuggcagcaaccggaaaaucagacaagauaugcauuggauaucaugccaacaauucaacaacaaagguagauacuauacucgagaagaacguaaccgucacacacucaguugagcugcuggagaaccagaaagaagaaagauucugcaaaaucucaaacaaggccccucucgaucuaagggauuguacccuagaggguuggauuuuggggaauccccgaugcggcauauugcuugcugaccaaagcuggucauacauaguggaacggccuaaugcccgaaaugggauuugcuauccuggaacauugaaugaaguugaagaauugaaggcacuuauuggaucaggggaaaggguagaaagguuugagauguuucccaagagcacaugggcaggaguggacaccaacaguggagugucaagugcuuguccucuugguaauggcccaucuuucuacaggaaucuucuauggauaauaaaacuaaagucaucagaauacccaguaauuagaggaacuuucaacaacacuggagacaagucaauucucuauuuuugggguguacaccauccuccugucacaacugaacaagaagcucuguaugguucuggugaucgauacguuagaaugggaacugaaagcaugaauuuugccaggaguccagaaauugcggcaaggccugcugugaauggucagagaggcagaaucgauuauuucugguccaucuuaaaaccaggggaaaccuugaauguagaaucuaaugggaauuugauagccccuugguaugcauacagauuugucaacaaagauaguaaaggggccauauucagaucuaauuuaccaauugagaacugugaugccacaugccagacuacugaaggagugauaagaaccaacaaaacauuucagaaugugagcccucuguggauuggagaaugccccaaguauguaaaaaguaagagucuaagacuugcaacuggacuaaggaauguuccacaaauagaaacuagaggacuuuuuggagcuauugcgggcuucauugaaggaggauggacuggaaugauugauggaugguauggcuaccaucaugaaaauucucaaggcucaggauaugcagcugauagagaaagcacucaaaaggcuauagacggaauuacaaacaaggucaauuccaucauugauaaaaugaacacacaauuugaggcuguaggucaugaguucucaaaccuggagagaaggauugacaaccuaaacaaaagaauggaagauggauuucuggaugucuggacauacaacgcugaacuauugguucuucuugaaaacgagagaacacuagaccuacaugaugcaaaugugaagaaccuacaugaaaaagucaaaucacaacuaagggacaaugcuaaugaccuagggaacgggugcuuugaauuuuggcauaagugugacaaugaauguauggagucugucaaaaaugguaccuaugacuaucccaaguaucaagcggagaguagguuaaacagacagaaaauagaaucgguaaaacuggagaacuuugauguguaucaaauccuugccauuuauaguacgguaucgagcagucuaguuuugguagggcugaucauggcaaugggucuuuggauguguucaaaugguucaaugcagugcaggauauguauauaa

SEQ ID NO: 41603 - RNA, 1701 nt, Artificial Sequence
  hemagglutinin__InfluenzaA__AHJ57707
augauugcauucauuguaauagcgauacugguaacaaccggaaaaucagacaagauaugcguuggauaucaugcuaacaauucaacaacgaagguagauacuauacucgagaagaacguaaccgucacacacucaguugaacugcuggagaaccagaaagaagaaagauucugcaaaaucucgaacaaggccccucucgaucuaagggauuguacccuggaggguuggauccuggggaauccccgaugcggcauauugcucgcugaccaaaguuggucauacauaguggaaaggccuaaugcccgaaaugggauuugcuauccugguacauugaaugaaguagaagaauugaaggcacuuauuggaucaggggaaagaguagaaagauuugagauguuuccuaaaaguacauggacaggaguggacaccaacaguggaguaucaagugcuuguccucuuggugaagguccaucuuucuacaggaaucuucuauggauaauaaaacacacgacaucaggauacccaguaauuaaaggaacuuacagaaacacuggagauaagucaguucucuauuuuuggggugugcaccauccuccugacacaacugaacagaauguucuguacgguucugguaaucgauacguuagaaugggaacugaaagcaugaauuuugccaggagcccagaaauugcggcaaggccugcugugaauggucagagaggcagaauugauuauuucugguccauuuuaaaaccaggggaaaccuugaauguagaaucuaaugggaauuuaauagccccuugguacgcauacagauuugucaacaaagacagcaaaggagccauauucagauccaauuuaccaaucgagaacugugaugccacuugccagacuacugaaggagugauaagaaccaacaaaacauuccagaaugugagcccucuguggauuggagaaugccccaaguauguaaaaagcaagagucuaaggcuugcaacuggacuaaggaauguuccacaaauagaaacuagaggacuauuuggggcuauugcaggcuucauugaagggggauggacuggaaugauugaugggugguauggcuaccaucaugaaaauucucaaggcucaggauaugcagcugauagagaaagcacucaaaaggcuauagacggaauuacgaacaaggucaauuccaucauugauaaaaugaacacacaauuugaggcuguaggucaugaguuuucaaaccuggaaagaaggauugacaaccuaaacaaaagaauggaagauggauuuuuggauguuuggacauacaacgccgaacuguugguucuucuugaaaacgaaagaacacuagaccuacacgaugcaaaugugaagaaccuacaugaaagggucagaucgcaacugagggacaaugcuaaugaccuagggaacggaugcuuugaauuuuggcauaagugugacaaugaauguauggagucagucaaaaaugguaccuauaacuaucccaaguaucaagcugagagcagauuaaacaaacagaaaauagaaucgguaaaacuagaggaguuuggcguguaucaaauccuugccauuuauaguacgguaucgagcagucuaguuuugguagggcugaucauggcaaugggucuuuggauguguucaaaugguucaaugcagugcaggauauguauauaa

SEQ ID NO: 41604 - RNA, 1701 nt, Artificial Sequence
  hemagglutinin__InfluenzaA__AHJ57719
augauugcauucauuguaauagcaauacuggcagcaaccggaaaaucagacaagauaugcauuggauaucaugccaacaauucaacaacaaagguagauacuauacucgagaagaacguaacugucacacacucaguugaacugcuggagaaccagaaagaagaaagauucugcaaaaucucaaacaaggccccucucgaucuaagggauuguacccuagaggguuggauauuggggaauccccgaugcggcauacugcuuucugaccaaagcuggucauacauaguggaacggccuaaugcccgaaaugggauuugcuauccuggaauauugaaugaagcugaagaauugaaggcacuuaucggaucaggggaaaggguagaaagguuugagauguuucccaaaaguacaugggcaggaguggacacuaacaguggagugucaagugcuuguccucuugguaauggcccaucuuucuucaggaaucuccuauggauaauaaaacuaaagucaucaacauacccaguaauuagaggaacuuucaacaacacuggagacaagucaauucucuauuuuuggggugugcaccauccuucugucacaacugaacaagaagcccuguaugguucugguaaucgauacguuagaaugggaacugaaagcaugaauuuugccaggaguccagaaauugcggcaagaccugcugugaauggucagagaggcagaaucgauuauuucugguccaucuuaaaaccaggggaaaccuugaauguagaaucuaaugggaauuuaauagccccuugguaugcauacagauucgucaacaaagauaguaaaggagccauauucagaucuaauuuaccaauugagaacugugacgccacaugccagacuauugaaggagugauaagaaccaacaaaacauuucaaaaugugagcccucuguggauuggagagugccccaaguauguaaagaguaaaagucuaagacuugcaacuggacuaaggaauguuccacaaauagaaacuagaggacuuuuuggagcuauugcaggcuucauugaaggaggauggacuggaaugauugaugggugguauggcuaccaucaugaaaauucucaaggcucaggauaugcagaugauaaagaaagcacucaaaaggccauagacggaauuacaaacaaggucaauuccaucauugauaaaaugaacacacaauuugaggcuguaggccaugaguuuucaaaccuggagagaaggauugacaaccuaaacaaaagaauggaagauggauuucuggauguuuggacauacaacgcugaacuauugguucuucuugagaacgaaagaacacuagaccuacaugaugcaaaugugaaaaaccuacaugaaaaggucagaucacaacuaagggacaaugcuaaugaccuagggaacgggugcuuugaauuuuggcauaagugcgacaaugaauguauggagucugucaaaaaugguaccuaugacuaucccaaguaccaagcggagagcagauuaaacagacagaaaauagaaucgguaaaacuggagaacuuugauguguaucaaauccuugccauuuauaguacgguaucgagcagucuaguuuugguagggcugaucauggcaaugggucuuuggauguguucaaaugguucaaugcaaugcaggauauguauauaa

SEQ ID NO: 41605 - RNA, 1701 nt, Artificial Sequence
  hemagglutinin__InfluenzaA__AHJ57731
augauugcauucauuguaauagcaauacuggcagcaaccggaaaaucagacaagauaugcauuggauaucaugccaacaauucaacaacaaagguagauacuauacucgagaagaacguaacugucacacacucaguugaacugcuggagaaccagaaagaagaaagauucugcaaaaucucaaacaaggccccucucgaucuaagggauuguacccuagaggguuggaucuuggggaauccccgaugcggcauacugcuugcugaccaaagcuggucauacauaguggaacggccuaaugcccgaaaugggauuugcuauccuggaauauugaaugaagcugaagaauugaaggcacuuaucggaucaggggaaaggguagaaagguucgagauguuucccaaaaguacaugggcaggaguggacacugacaguggagugucaagugccuguccucuugguaacggcccaucuuucuacaggaaucuucuauggauaauaaaacuaaagucaucagaauauccaguaauuagaggaacuuucaacaacacuggagacaagucaauucucuauuuuuggggugugcaccauccuccugucacaacugaacaagaagcccuguaugguucugguaaucgauacguuagaaugggaacugaaagcaugaauuuugccaggaguccagaaauugcggcaaggccugcugugaauggucagagaggcagaaucgauuauuucugguccaucuuaaaaccaggggaaaccuugaauguagaaucuaaugggaauuuaauagccccuugguaugcauacagauuugucaacaaagauaguaaaggagccauauucagaucuaauuuaccaauugagaacugugacgccacaugccagacuacugaaggagugauacgaaccaacaaaacauuucagaaugugagcccucuguggauuggagaaugccccaaguauguaaagaguaaaagucuaagacuugcaacuggacuaaggaauguuccacaaauagaaacuagaggacuuuuuggagcuauugcaggcuucauugaaggaggauggacuggaaugauugaugggugguauggcuaccaucaugaaaauucucaaggcucaggauaugcagcugauagagaaagcacucaaaaggccauagacggaauuacaaacaaggucaauuccaucauugauaaaaugaacacacaauuugaggcuguaggccaugaguuuucaaaccuggagagaaggauugacaaccuaaacaaaagaauggaagauggauuucuggauguuuggacauacaacgcugaacuauugguucuucuugaaaacgaaagaacacuagaccuacaugaugcaaaugugaagaaccuacaugaaaaggucagaucacaacuaagggacaaugcuaaugaccuagggaacgggugcuuugaauuuuggcacaagugugacaaugaauguauggagucugucaaaaaugguaccuaugacuaucccaaguaccaaacggagaguagguuaaacagacagaaaauagaaucgguaaaacuggagaacuuugauguguaucaaauccuugccauuuauaguacgguaucgagcagucuaguuuugguagggcugaucauggcaaugggucuuuggauguguucaaaugguucaaugcagugcaggauauguauauaa

SEQ ID NO: 41606 - RNA, 1701 nt, Artificial Sequence
  hemagglutinin__InfluenzaA__AHJ57743
augauugcauucauuguaauagcaauacugguagcaacuggaaaaucagacaaaauaugcauuggauaucaugccaacaauucaacaacaaaaguagauacgauacucgagaagaacguaaccgucacacacucaguugaacugcuggagaaccagaaagaagaaagauucugcaaaaucucaaacaaggccccucucgaccuaagggauuguaccauagaggguuggaucuuggggaauccccgaugcggcauacugcuugcugaccaaagcuggucauacauaguggaacggccugaugcccgaaaugggauuugcuauccugggacauugaaugaagcagaagaauugaaggcacuuauuggaucaggggaaaagguagaaagguuugagauguuucccaaaaguacaugggcaggaguggacaccagcaguggaguaucaagugcuuguccucuugguaaugguccaucuuucuauaggaaucuucuauggauaauaaaacucaaguccucagaauauccaguaauuagaggaacuuucaacaacacuggagacaagucaguucucuauuuuugggguguacaccacccuccugucacaacugaacaaaaugcucuguaugguucugguaauagguauguuagaaugggaacugaaagcaugaauuuugccagaagcccagaaauugcggcaaggccugcugugaauggucagagaggcagaaucgauuauuucugguccaucuuaaaaccaggggaaaccuugaauguagaaucuaacgggaauuuaauagccccuugguaugcauacagauuugucaacaaagauagcaaaggagccauauucagaucuaauuuaccaauugaaaacugugaugccacaugccagacuauugaaggagugauaagaaccaacaaaacauuucagaaugugagcccucuguggauuggagaaugccccaaguauguaaaaaguaagagucuaaggcuugcaacuggacuaaggaauguuccacaaauagaaacuagaggacuuuuuggagcuauugcaggcuucauugaaggaggauggacugguaugauugaugggugguauggcuaccaucaugaaaauucucaaggcucaggauaugcagcugauagagaaagcacucaaaaggcuauagacggaauuacaaacaaggucaauuccaucauugauaaaaugaacacacaauuugaggcugcaggucaugaguuuucaaaccuggagaggaggauugacaaccuaaacaaaagaauggaagauggauuucuggauguuuggacauacaacgccgaacuauugguucuucuugaaaacgaaagaacacuagaccuacaugaugcaaaugugaagaaccuacaugaaaaggucaaaucacaacuaagggacaaugcuaaugaccuagggaacgggugcuuugaauuuuggcauaagugugacaaugaauguauggagucugucaaaaaugguaccuaugacuaucccaaguaucaaaaagagaguagguuaaacagacagaaaauagaaucgguaaaacuggagaacuuugauguguaucaaauccuugccauuuauaguacgguaucgagcagucuaguuuugguagggcugaucauggcaaugggucuuuggauguguucaaaugguucaaugcagugcaggauauguauauaa

SEQ ID NO: 41607 - RNA, 1701 nt, Artificial Sequence
  hemagglutinin__InfluenzaA__AHJ57755
augauugcauucauuguaauagcaauacugguagcaaccggaaaaucagacaagauaugcauuggauaccaugccaacaauucaacaacaaagguagauacgauacuugagaagaacguaaccgucacacacucaguugagcugcuggagaaccagaaagaagaaagauucugcaaaaucucaaacaaggccccucucgaccuaagggauuguaccauagaggguuggaucuuggggaauccccgaugcgacauacugcuugcugaccaaagcuggucauacauaguggaacggccuaaugcccgaaaugggauuugcuauccuggaacauugaaugaagcagaagaauugaaggcacuuauuggaucaggggaagggguagaaagauuugagauguuucccaaaaguacauggguaggaguggacaccagcaguggaguaucaagugcuuguccucuugguaaugguccaucuuucuacaggaaucuucuauggauaauaaaacucaaguccucagaauauccaguaauuagaggaacuuucaacaacacuggagacaagucaguucucuauuuuugggguguacaccauccuccugucacaacugaacaaaaugcucuguaugguucugguaauagauauguuagaaugggaacugaaagcaugaauuuugccagaagcccagaaauugcggcaaggccugcugugaauggucagagaggcagaaucgauuauuucugguccaucuuaaaaccaggggaaaccuugaauguagaaucuaacgggaauuuaauagccccuugguaugcauacagauuugucaacaaagauaauaaaggagccauauucagaucuaauuuaccaauugagaacugugaugccacaugucagacuacugaaggagugauaagaaccaacaaaacauuucagaaugugagcccucuguggauuggagaaugccccaaguauguaaaaaguaagagucuaaggcuugcaacuggacuaaggaauguuccacaaauagaaacuagaggacuuuuuggagcuauugcaggcuucauugaaggaggauggacugguaugauugaugggugguauggcuaccaucaugaaaauucucaaggcucaggauaugcagcugauagagaaagcacucaaaaggcuauagacggaauuacaaacaagguaaauuccaucauugauaaaaugaacacacaauuugaggcugcaggucaugaguuuucaaaccuggagagaaggauugacaaccuaaacaaaagaauggaagauggauuucuagauguuuggacauacaacgccgaacuauugguucuucuugaaaacgaaagaacacuagaccuacaugaugcaaaugugaagaaccuacaugaaaaggucaaaucacaacuaagggacaaugcuaaugaccuagggaacgggugcuuugaauuuuggcauaagugugacaaugaauguauggagucugucaaaaaugguaccuaugacuaucccaaguaucaaaaagagaguagguuaaacagacagaaaauagaaucaguaaaacuggaaaacuuugauguguaucaaauccuugccauuuauaguacgguaucgagcagucuaguugugguagggcugaucauggcaaugggucuuuggauguguucaaaugguucaaugcagugcaggauauguauauaa

SEQ ID NO: 41608 - RNA, 1701 nt, Artificial Sequence
  hemagglutinin__InfluenzaA__AHJ57767
augauugcauucauuguaauagcgauacuggcagcaaccggaaaaucagacaagauaugcauuggauaucaugccaacaauucaacaacaaagguagauacuauacucgagaagaacguaaccgucacacacucaguugagcugcuggagaaccagaaagaagaaagauucugcaaaaucucaaacaaggccccucucgaucuaagggauuguacccuagaggguuggaucuuggggaauccccgaugcggcauauugcuugcugaccaaagcuggucauacauaguggaacggccuaaugcccgaaaugggauuugcuauccuggaacauugaaugaaguugaagaauugaaggcacuuauuggaucaggggaaaggguagaaagguuugagauguuucccaagagcacaugggcaggaguggacaccaacaguggagugucaagugcuuguccucuugguaauggcccaucuuucuacaggaaucuucuauggauaauaaaacuaaagucaucagaauacccaguaauuagaggaacuuucaacaacacuggagacaagucaauucucuauuuuugggguguacaccauccuccugucacaacugaacaagaagcucuguaugguucuggugaucgauacguuagaaugggaacugaaagcaugaauuuugccaggagcccagaaauugcggcaaggccugcugugaauggucagagaggcagaaucgauuauuucugguccaucuuaaaaccaggggaaaccuugaauguagaaucuaaugggaauuuaauagccccuugguaugcauacagauuugucaacaaagauagcaaaggggccauauucagaucuaauuuaccaaucgagaacugugaugccacaugccagacuacugaaggagugauaagaaccaacaaaacauuucagaaugugagcccucuguggauuggagaaugccccaaguauguaaaaaguaaaagucuaaggcuugcuacuggacuaaggaauguuccacaaauagaaacuagaggacuuuuuggagcuauugcgggcuucauugaaggaggguggacuggaaugauugaugggugguacggcuaccaucaugaaaguucucaaggcucaggauaugcagcugauaaagaaagcacucaaaaggccauagacggaaucacaaacaaggucaauuccaucauugauaaaaugaauacacaauuugaggcuguaggucaugaguuuucaaaccuggagagaaggauugacaaccuaaacaaaagaauggaagauggauuucuggauguuuggacauauaaugcugaacuguugguucuucuugaaaacgaaagaacacuagaccuacaugaugcaaauguaaagaaccugcaugaaaaggucagaucacaacuaagggacaaugcuaaugaccuagggaacggaugcuuugaauuuuggcauaaguguaacaaugaauguauggagucugucaaaaaugggaccuaugacuaucccaaauaucaaaaggagaguagguuaaauagacagaaaauagaaucgguaaaacuggagaauuuugauguguaucaaauccuugccauuuauaguacgguaucgagcagucuaguuuugguagggcugauccuggcaaugggucuuuggauguguucaaaugguucaaugcagugcaggauauguauauaa

SEQ ID NO: 41609 - RNA, 1701 nt, Artificial Sequence
  hemagglutinin__InfluenzaA__AHJ57779
augauugcaaucauaauaauagcaauacugguagcaacuggaaaaucagacaagauaugcauuggauaucaugccaacaauucaacaacaaagguagauacgauacucgagaagaacguaaccgucacacacucaguugaacugcuggaggaccagaaagaagaaagauucugcaaaaucucaaacaaggccccucucgaccuaagggauuguaccauagaggguuggaucuuggggaauccccgaugcggcauacugcuugcugaccaaagcuggucauacauaguggaacggccuaaugcccgaaaugggauuugcuauccugggacauugaaugaagcagaagaauugaaagcacuuauuggaucaggggaagggguagaaagguuugagauguuucccaagaguacaugggcaggaguggacaccaacaguggaguaucaagugcuuguccucuugguaaugguccaucuuucuacaggaaucuucuauggauaauaaaacucaaguccucagaauauccaguaauuagaggaacuuucaacaacacuggagacaagucaguucucuauuuuugggguguacaccauccuccugucacaacugaacaaaaugcucuguaugguucugguaauagauauguuagaaugggaacugaaagcaugaauuuugccagaagcccagaaauugcggcaaggccugcugugaauggucagagaggcagaaucgauuauuucugguccaucuuaaaaccaggagaaaccuugaauguagaaucuaacgggaauuuaauagccccuugguaugcauacagauuugucaacaaagauaguaaaggagccauauucagaucuaauuuaccaauugagaacugugaugccacaugccagacuacugaaggagugauaagaaccaacaaaacauuucagaaugugagcccucuguggauuggagaaugccccaaguauguaaaaaguaagagucuaaggcuugcaacuggacuaaggaauguuccacaaauagaaacuagaggacuuuuuggagcuauugcaggcuucauugaaggaggauggacugguaugauugaugggugguauggcuaccaucaugaaaauucucaaggcucaggauaugcagcugauagagaaagcacucaaaaggcuauagacggaauuacaaacaagguaaauuccaucauugauaaaaugaacacacaauuugaggcugcaggucaugaguuuucaaaccuggagagaaggauugacaaccuaaacaaaagaauggaagauggauuucuggauguuuggacauacaacgccgaacuauugguucuucuugaaaacgaaagaacacuagaccuacaugaugcaaaugugaagaaccuacaugaaaaagucaaaucacaacuaagggacaaugcuaaugaccuagggaacggguguuuugaauuuuggcauaagugugacaaugaauguauggagucugucaaaaaugguaccuaugacuaucccaaguaucaaaaagagaguagguuaaacagacaaaaaauagaaucgguaaaacuggagaacuuugauguguaucaaauccuugccauuuauaguacgguaucgagcagucuaguuuugguagggcugaucauggcaaugggucuuuggauguguucaaaugguucaaugcagugcaugauauguauauaa

SEQ ID NO: 41610 - RNA, 1701 nt, Artificial Sequence
  hemagglutinin__InfluenzaA__AHJ57791
augauugcaaucauaauaauagcgauacugguaacaaccggaaaaucagacaagauaugcauuggauaucaugcuaacaauucaacaacaaagguagauacaauacucgagaagaauguaaccgucacacacucaguugaacugcuggagaacaagaaagaagaaagauucugcaaaaucucgaacaaagccccucucgaucuaagggauuguacccuagaggguuggaucuuggggaauccccgaugcggcauauugcuugcugaccaaagcuggucauacauaguggaacggccuaaugcccgaaaugggauuugcuauccuggaacauugaaugaaguaaaagaauugaaggcacuuauugggucaggggaaagaguaaaaagauuugagauguuccccaaaaguacaugggcaggaguggacaccaacaguggaguaucaaguucuuguccucuugguaaugguccaucuuucuacaggaaucuucuauggauaauaaaacacacgacaucaggguacccaguaauuaaaggaacuuacacaaacacuggagauaagucaguucucuauuuuugggguauacaccauccuccugacacaacugaacaaaauguucuguaugguucugguaaucgauacguuagaaugggaaccgaaagcaugaauuuugccaggagcccagaaauugcggcaaggccugcugugaauggucagagaggcagaauugauuauuucugguccauuuuaaaaccgggggaaaccuugaauguagaaucuaaugggaauuuaauagccccuugguacgcguacagauuugucaacaaagauagcaaaggagccauauucagaucuaauuuaccaaucgaggacugugaugccacuugccagacuacugaaggagugauaagaaccaacaaaacauuucagaaugugagcccucuguggauuggagagugccccaaguauguaaaaaguaagagucuaaggcuugcaacugggcuaaggaauguuccacaaauagaaacuagaggacuauuuggagcuauugcaggcuucauugaagggggauggacuggaaugauugacgggugguauggcuaccaucaugaaaauucucaaggcucaggauaugcagcugauagagaaagcacucaaaaggcuauagacggaauuacgaacaaggucaauuccaucauugauaaaaugaacacacaauuugaggcuguaggucaugaguuuucaaaccuggaaagaaggauugacacacuaaacaaaagaauggaagauggauuucuggauguuuggacauacaacgcugaacuguugguucuucuugaaaacgaaagaacacuagaccuacaugaugcaaaugugaagaaccugcaugaaagggucaaaucacagcugagggacaaugcuaaugaccuagggaacggaugcuuugaauuuuggcauaagugugacaaugaauguauggagucagucaaaaaugguaccuauaacuaucccaaguaucaagcugagaguagauuaaauaaacagaagauagaaucgguaaaacuggaggaguuuggcguguaucaaauccuugccauuuauaguacgguaucgagcagucuaguuuugguagggcugaucauggcaaugguucuuuggauguguucaaaugguucaaugcagugcaggguauguauauaa

SEQ ID NO: 41611 - RNA, 1701 nt, Artificial Sequence
  hemagglutinin__InfluenzaA__AHJ57815
augauugcauucaucauaauaacgauacugguaacaaccggaaaaucagacaagauaugcauuggauaucaugccaacaauucaacaacaaagguagauacaauacucgagaagaacguaaccgucacacacucaguagaacugcuggaaaaccagaaagaagagagauucugcagaaucucaaacaaggccccucucgaucuaaaggaguguacccuagaggguuggaucuuggggaauccccaaugcgauuuauuacuuggugaccaaagcuggucauacauaguggagcggcccaaugcccgaaaugggauuugcuacccuggaacguugaaugagguagaagaauugagggcacuuauuggaucaggggaaggaguagagagguuugagauguuucccaaaaguacaugggcaggaguggacaccaaccgugguguaacaaguucuuguccuuuugguagugguucaucuuucuacaggaaccuccuauggauaguaaaacacaccacaucaucauauccaguaauuaaaggaacuuucagaaacacuggagacaagucaguucucuauuuuugggguguacaccauccauuugacacgaaugagcaaaauguucuguaugguucugguaaucgauacguuaggaugggaacugaaagcaugaauuuugccagggguccagaaguugcggcaaggccuguugugaauggucagagaggcagaauugauuauuucugguccauuuuaaaaccaggggaaaccuugaacauagaaucuaacgguaauuuaauagccccuugguaugcauacagguuugucaacaaagauaguaagggagccauauucagaucuaauuuaccaaucgaggacugugaugccacaugccagacuauugaaggagugauaagaaccaacaaaacauuucagaaugugagccccuuguggauaggagaaugccccaaguauguaaaaagugagagucuaaggcuugcaacuggacuaaggaauguaccacagauagaaacaagaggacuuuuuggagcuauugcaggcuucauugaaggaggauggacuggaaugauugaugggugguacggcuaucaucacgaaaauucccaaggaucaggguaugcagcugauagagaaagcacucagaaggcuauagacggaauuacaaccaaggucaauuccauaauugauaaaaugaacacucaauuugaggcuguaggucaugaauuuucaaaccuggagagaaggauugacaaucuaaacaaaagauuggaagauggauuucuggauguuuggacauacaaugcugaauuguugguucuucuugaaaacgaaagaacacuagaccuacaugaugcaaaugugaagaaucuacaugaaagggucagaucacaacuaagggacaaugcuaaugaucuagggaauggauguuucgaauuuuggcauaaaugugacaaugaauguauggagucugucaaaaaugguaccuauaacuaucccaaguaucaagcugaaaguagguuaaacaaacagagaauagagucgguaaaacuggagaauuuugauguguaucaaauccucgccauuuauaguacgguaucgagcagucuaguuuugguagggcugauuuuggcaaugggucuuuggauguguucaaaugguucaaugcagugcaggauauguauauaa

SEQ ID NO: 41612 - RNA, 1701 nt, Artificial Sequence
  hemagglutinin__InfluenzaA__AHJ57827
augauugcauucauuguaauagcgauacugguagcaaccggaaaaucagacaagauaugcauuggauaucaugcaaacaauucaacaacaaagguagauacgauacuugagaaaaacguaacugucacacacucaguugaacugcuggagaaccagaaagaagaaagauucugcaaaaucucaaacaaggccccucucgaccuaagggauuguaccauagaagguuggaucuuggggaauccccgaugcggcauauugcuugcugaccaaagcuggucauacauaguggaacggccuaacgcccggaaugggauuugcuauccuggaacauugaaugaaguagaagaauugaaggcacuuauuggaucaggagaaagaguagaaagguuugagauguuucccaaaaguacaugggcaggaguggacaccaacaguggaguaucaagugcuuguccucuuggaaauggcccaucuuucuacaggaaucuucuauggauaauaaaaaccaagucaucagaauauccaguaauuaaaggaacuuucaacaacacuggagacaagucaguucucuauuuuugggguguacaccauccuccuagcagaaaugaacaaaauguucuguaugguucuggugaucgauacguuagaaugggaacugaaagcaugaauuuugccaggagcccagaaauugcggcaagaccugcugugaauggucagagaggcagaauugauuacuucugguccauuuuaaaaccaggagaaaccuugaauguagaaucuaacgggaauuuaauagccccuugguaugcauacagauuugucaacaaggauaguagaggagccauauucagaucuaauuuaccaaucgagaacugugaugccacaugccagacugcugaaggagugauaagaaccaacaaaacauuucagaaugugagcccucuguggauuggagaaugccccaaguauguaaaaaguaagagucuaaggcuugcaacuggacuaaggaauguuccacaaauagaaacuagagggcuuuuuggagcuauugcaggcuucauugaaggaggauggacuggaaugauugaugggugguauggcuaccaccaugaaaauucucaaggcucaggauaugcagcugauagagaaagcacccaaaaggcuauagacggaauuacaaacaaggucaauuccaucauugacaaaaugaacacacaauuugaggcuguaggucaugaguuuucaaaccuggaaagaaggauugacaaccuaaacaaaagaauggaagauggauuucuggauguuuggacauacaacgcugaacuguugguucuucuugaaaacgaaagaacacuagaccuacaugaugcaaaugugaagaaccuacaugaaagggucaaaucacaacuaagggacaaugcuaaugaucuagggaacgggugcuuugaauuuuggcauaagugugacaaugaauguauggagucugucaaaaaugguaccuaugacuaccccaaguaucaaaaagagaguagguuaaacagacagaaaauagaaucgguaaaacuggagaauuuugauguguaucaaauccuugccauuuauaguacgguaucgagcagucuaguuuugguagggcugaucauggcaaugggucuuuggauguguucaaaugguucaaugcagugcaggauauguauauaa

SEQ ID NO: 41613 - RNA, 1701 nt, Artificial Sequence
  hemagglutinin__InfluenzaA__AHJ57850
augauugcauucauuguaauagcaauacuggcaacaaccggaaaaucagacaagauaugcauuggauaucaugccaacaauucaacaacaaagguagauacuauacucgagaagaacguaacugucacacacucaguugaacuacuggagaaccagaaagaagaaagauucugcaaaaucucaaacaaagccccucucgaucuaagggauuguacccuagaggguuggaucuuggggaauccucgaugcggcauacugcuugcugaccaaagcuggucauacauaguggaacggccuaaugcccgaaaugggauuugcuauccuggaauauuaaaugaagcugaagaauugaaggcacuuaucggaucaggggaaaggguagaaagguuugagauguuucccaaaaguacaugggcaggaguggacacugacaguggagugucaagugcuuguccucuugguaauggcccaucuuucuacaggaaucuucuauggauaauaaaacuaaagucaucagaauauccaguaauuagaggaacuuucaacaacacuggagacaagucaauucucuauuuuuggggugugcaccauccuccugucacaacugaacaagaagccuuguaugguucugguaaucgauacguuagaaugggaacugaaagcaugaauuuugccaggacuccagaaauugcggcaaggccugcugugaauggucagagaggcagaaucgauuauuucugguccaucuuaaaaccaggggaaaccuugaauguagaaucuaaugggaauuuaauagccccuugguaugcauacagauuugucaacaaagauaguaaaggagccauauucagaucuaauuuaccaauugagaacugugacgccacaugccagacuacugaaggagugauaagaaccaacaaaacauuucagaaugugagcccucuguggauuggagaaugccccaaguauguaaagaguaaaagucuaagacuugcaacuggacuaaggaauguuccacaaauagaaacuaggggacuuuuuggagcuauugcaggcuucauugaaggaggauggacuggaaugauugaugggugguauggcuaccaucaugaaaauucucaaggcucaggauaugcugcugauagagaaagcacucaaaaggccauagacggaauuacaaacaaggucaauuccaucauugauaaaaugaacacacaauuugaggcuguaggccaugaguuuucaaaccuggagagaaggauugacaaccuaaacaaaagaauggaagauggauuucuggauguuuggacauacaacgcggaacuauugguucuucuugaaaacgaaagaacacuagaccuacaugaugcaaaugugaagaaccuacaugaaaaggucagaucacaacuaagggacaaugcuaaugaccuagggaaugggugcuuugaauuuuggcauaagugugacaaugaauguauggaguccgucaagaaugguaccuaugacuaucccaaguaccaagcggagaguagguuaaacagacagaaaauagaaucgguaaaacuggaaaacuuugauguguaucaaauccuugccauuuauaguacgguaucgagcagucuaguuuugguagggcugaucauggcaaugggucuuuggauguguucaaaugguucaaugcagugcaggauauguauauaa

SEQ ID NO: 41614 - RNA, 1701 nt, Artificial Sequence
  hemagglutinin__InfluenzaA__AHJ57862
augauugcauucauuguaauagcaauacuggcagcaaccggaaaaucagacaagauaugcauuggauaucaugccaacaauucaacaacaaagguagauacuauacucgagaagaacguaacugucacacacucaguugaacugcuggagaaccagaaagaagaaagauucugcaaaaucucaaacaaggccccucucgaucuaagggauuguacccuagaggguuggaucuuggggaauccccgaugcggcauacugcuugcugaccaaagcuggucauacauaguggaacggccuaaugcccgaaaugggauuugcuauccuggaauauugaaugaagcugaagaauugaaggcacuuaucggaucaggggaaaggguagaaagauuugagauguuucccaaaaguacaugggcaggaguggacaccaacaguggagugucaagugcuuguccucuugguaauggcccaucuuucuacaggaaucuucuauggauaauaaaacuaaagucaucagaauauccaguaauuagaggaacuuucaacaacacuggagacaagucaauucucuauuuuuggggugugcaucauccuccugucacaacugaacaagaagcccuguaugguucugguaaucgauacguuagaaugggaacugaaagcaugaauuuugccaggaguccagaaauugcggcaaggccugcugugaauggucagagaggcagaaucgauuauuucugguccaucuuaaaaccaggggaaaccuugaauguagaaucuaaugggaauuuaauagccccuugguaugcauacagauuugucaacaaagauaguaaaggagccauauucagaucuaauuuaccaauugagaacugugacgccacaugccagacuacugaaggagugauaagaaccaacaaaacauuucagaaugugagcccucuguggauuggagaaugccccaaguauguaaagaguaaaagucuaagacuugcaacuggacuaaggaauguuccacaaauagaaacuagaggacucuuuggagcuauugcagguuucauugaaggaggauggacuggaaugauugaugggugguauggcuaccaucaugaaaauucucaaggcucaggauaugcagcugacagagaaagcacucaaaaggccauagacggaauuacaaacaaggucaauuccaucauugauaaaaugaacacacaauuugaggcuguaggccaugaguuuucaaaccuggagagaaggauugacaaccuaaacaaaagaauggaagauggauuucuggauguuuggacauacaacgcggaacuauugguucuucuugaaaacgaaagaacacuagaccuacaugaugcaaaugugaagaaccuacaugaaaaggucaggucacaacuaagggacaaugcuaaugaccuagggaacgggugcuuugaauuuuggcauaagugugacaaugaauguauggagucugucaaaaaugguacuuaugacuaucccaaguaccaagcggagaguagguuaaacagacagaaaauagaaucgguaaaacuggagaacuuugauguguaucaaauccuugccauuuauaguacgguaucgagcagucuaguuuugguagggcugaucauggcaaugggucuuuggauguguucaaaugguucaaugcagugcaggauauguauauaa

SEQ ID NO: 41615 - RNA, 1701 nt, Artificial Sequence
  hemagglutinin__InfluenzaA__AHJ57873
augauugcauucauuguaauagcaacacugguagcaaccggaaaaucagacaagauaugcaugggauaucaugcaaacaauucgacaacaaagguagauacgauacuugagaagaacguaacugucacacacucaguugaacugcuggagaaccagaaagaagaaagauucugcaagaucucaaacaaggccccucucgaucuaagggauuguacccuagaagguuggauauuggggaacccccgaugcggcauauugcuagcugaccaaagcuggucauacauaguagaacggccuaaugcccgaaaugggauuugcuauccuggaacauugaaugaagcagaagaauuaaaggcacuuauuggaucaggagaaaggguagaaagguuugagauguuucccaaaagcacauggacaggaguggacaccgaaaguggaguaucaagugcuuguccucuugguaaugguccaucuuucuacaggaaucuucuauggauaauaaaacucaagucaucagaauauccaguaaucagaggaacuuucaacaacacuggagacaagucaauucucuauuuuugggguguacaccauccuccugucacaacugaacaaaaugcucuguaugguucuggugaucgauauguuagaaugggaacugaaagcaugaauuuugccaggagcccagaaauugcggcaagaccugcugugaauggucagagaggcagaauugauuauuucugguccaucuuaacaccuggggaaaccuugaauguagaaucuaaugggaauuuaauagccccuugguaugcauacagauuugucaacaaagauagcaaaggggccauauucagaucuaauuuaccaaucgagaacugugaugccacaugccagacuacugaaggagugauaagaaccaacaaaacauuucagaaugugagcccucuguggauuggagaaugccccaaguauguaaaaaguaaaagucuaaggcuugcaacuggacuaaggaauguuccacaaauagaaacuagaggacuuuuuggagcuauugcaggcuucauugaaggaggguggacuggaaugauugauggaugguacggcuaccaucaugaaaauucucaaggcucaggauaugcagcugauaaagaaagcacucaaaaggccauagacggaauuacaaacaaggucaauuccaucauugauaaaaugaauacacaauuugaggcuguaggucaugaguuuucaaaccuggagagaaggauugacaaccuaaacaaaagaauggaagauggauuucuggauguuuggacauauaaugcugaacuguugguucuucuugaaaacgaaagaacacuagaccuacaugaugcaaauguaaagaaccugcaugaaaaggucaggucacaacuaagggacaaugcuaaugaccuagggaacggaugcuuugaauuuuggcauaagugugacaaugaauguauggagucugucaaaaaugggaccuaugacuaucccaaauaucaaaaggagaguagguuaaauagacagaaaauagaaucgguaaaacuggagaauuuugauguguaucaaauccuugccauuuauaguacgguaucgagcagucuaguuuugguagggcugauccuggcaaugggucuuuggauguguucaaaugguucaaugcacugcaggauauguauauaa

SEQ ID NO: 41616 - RNA, 1701 nt, Artificial Sequence
  hemagglutinin__InfluenzaA__AHJ57885
augauugcauucauuguaauggcaauacuggcagcaaccggaaaaucagacaagauaugcauuggauaucaugccaacaauucaacaacaaagguagauacuauacucgaaaagaacguaacugucacacacucaguugaacuacuggagaaccagaaagaagaaagauucugcaaaaucucaaacaaggccccucucgaucuaagggauuguacccuagaggguuggaucuuggguaauccccgaugcggcauacugcuugcugaccaaagcuggucauacauaguggaacggccuaaugcccgaaaugggauuugcuauccuggaauauugaaugaagcugaagaauugaaggcacuuaucggaucaggggaaaggguagaaagguuugagauguuucccaaaaguacaugggcaggaguggacacugacaguggagugucaagugcauguccucuugguaauggcccaucuuucuacaggaaucuucuauggauaauaaaacgaaagucaucagcauauccaguaauuagaggaacuuucaacaacacuggagacaagucaauucucuauuuuuggggugugcaccauccuccugucacaacugaacaagaagcccuguaugguucugguaaucgauacguuagaaugggaacugaaagcaugaauuuugccaggaauccagaaauugcggcaaggccugcugugaauggucagagaggcagaaucgauuauuucugguccaucuuaaaaccaggggaaaccuugaauauagaaucuaaugggaauuuaauagccccuugguaugcauacagauuugucaacaaagauaguaaaggagccauauucagaucuaauuuaccaauugaggacugugacgccucaugccagacuacagaaggagugauaagaaccaacaaaacauuucagaaugugagcccucuguggauuggagaaugccccaaguauguaaagaguaaaagucuaagacuugcaacuggacuaaggaauguuccacaaauagaaacuagaggacuuuuuggagcuauugcaggcuucauugaaggaggauggacuggaaugauugaugggugguauggcuaccaucaugaaaauucucaaggcucaggauaugcagcugauagagaaagcacucaaaaggccauagacggaauuacaaacaaggucaauuccaucauugauaaaaugaacacacaauuugaggcuguaggccaugaguuuucaaaccuggagagaaggauugacaaccuagacaaaagaauggaagauggauuucuggauguuuggacauacaacgcggaacuauugguucuucuugaaaacgaaagaacacuagaccuacaugaugcaaaugugaagaaccuacaugaaaaggucagaucacaacuaagggacaaugcuaaugaccuagggaacgggugcuuugaauuuuggcauaagugugacaaugaauguauggagucugucaaaaaugguaccuaugacuaucccaaguaccaagcggagaguagguuaaacagacagaaaauagaaucgguaaaacuggagaacuuugauguguaucaaauccuugccauuuauaguacgguaucgagcagucuaguuuugguagggcugaucauggcaaugggucuuuggauguguucaaaugguucaaugcagugcaggauauguauauaa

SEQ ID NO: 41617 - RNA, 1701 nt, Artificial Sequence
  hemagglutinin__InfluenzaA__AHJ57897
augauugcauucauuguaauagcaauacuggcagcaaccggaaaaucagacaagauaugcauuggauaucaugccaacaauucaacaacaaagguagauacuauacucgaaaagaacguaacugucacacacucaguugaacuacuggagaaccagaaagaagaaagauucugcaaaaucucaaacaaggccccucucgaucuaagggauuguacccuagaggguuggaucuuggguaauccccgaugcggcauacugcuugcugaucaaagcuggucauacauaguggaacggccuaaugcccgaaaugggauuugcuauccuggaauauugaaugaagcugaagaauugaaggcacuuaucggaucaggggaaaggguagaaagguuugagauguuucccaaaaguacaugggcaggaguggacacugacaguggagugucaagugcauguccucuugguaauggcccaucuuucuacaggaaucuucuauggauaauaaaacgaaagucaucagcauauccaguaauuagaggaacuuucaacaacacuggagacaagucaauucucuauuuuuggggugugcaccauccuccugucacaacugaacaagaagcccuguaugguucugguaaucgauacguuagaaugggaacugaaagcaugaauuuugccaggaauccagaaauugcggcaaggccugcugugaauggucagagaggcagaaucgauuauuucugguccaucuuaaaaccaggggaaaccuugaauauagaaucuaaugggaauuuaauagccccuugguaugcauacagauuugucaacaaagauaguaaaggagccauauucagaucuaauuuaccaauugaggacugugacgccucaugccagacuacagaaggagugauaagaaccaacaaaacauuucagaaugugagcccucuguggauuggagaaugccccaaguauguaaagaguaaaagucuaagacuugcaacuggacuaaggaauguuccacaaauagaaacuagaggacuuuuuggagcuauugcaggcuucauugaaggaggauggacuggaaugauugaugggugguauggcuaccaucaugaaaauucucaaggcucaggauaugcagcugauagagaaagcacucaaaaggccauagacggaauuacaaacaaagucaauuccaucauugauaaaaugaacacacaauuugaggcugugggccaugaguuuucaaaccuggagagaaggauugacaaccuaaacaaaagaauggaagauggauuucuggauguuuggacauacaacgcggaacuauugguucuucuugaaaacgaaagaacacuagaccuacaugaugcaaaugugaagaaccuacaugaaaaggucagaucacaacuaagggacaaugcuaaugaccuagggaacgggugcuuugaauuuuggcauaagugugacaaugaauguauggaguccgucaaaaaugguaccuaugacuaucccaaguaucaagcggagaguagguuaaacagacaaaaaauagaaucgguaaaacuggagaacuuugauguguaucaaauccuugccauuuauaguacgguaucgagcagucuaguuuugguagggcugaucauggcaaugggucuuuggauguguucaaaugguucaaugcagugcaggauauguauauaa

SEQ ID NO: 41618 - RNA, 1701 nt, Artificial Sequence
  hemagglutinin__InfluenzaA__AHJ57908
augauugcauucauuguaauagcaauacugguagcaaccggaaaaucagacaagauaugcauuggauaucaugccaacaauucaacaacaaagguagauacgauacuugaaaagaauguaaccgucacacacucaguugaacugcuggagaaccagaaagaagaaagauucugcaaaaucucaaacaaagccccucucgaucuaagggauuguaccguagaggguuggaucuuggggaauccccgaugcggcauacugauugcugaccaaagcuggucguacauaguggaacggccuaaugcccgaaaugggauuugcuauccuggaacauugaaugaagcagaagaauugaaggcacuuauuggaucgggggaagggguagaaagauuugagauguuucccaaaaguacaugggcaggaguggacaccagcaguggaguaucaagugcuuguccucuugguaaugguccaucuuucuacaggaaucuucuauggauaauaaaacucaagucaucagaauauccaguaauuagaggaacuuucaacaacacuggagacaagucaguucucuauuuuuggggugugcaccauccuccugucacaacugaacaagaugcucuguaugguucugguaaucgauauguuagaaugggaacugaaagcaugaauuuugccagaagcccagaaauugcggcaaggccugcugugaauggucagagaggcagaaucgauuauuucuggucagucuuaaaaccaggggaaaccuugaauguagaaucuaacggaaauuuaauagccccuugguaugcauacagauuuguuaacaaagauaauaaaggagccauauucagaucuaauuuaccaauugagaacugugaugccacaugccagacuacugaaggagugauaagaaccaacaaaacauuucagaaugugagcccucuguggauuggagaaugccccaaguauguaaaaaguaagagucuaaggcuugcaacuggacuaaggaauguuccacaaauagaaacuagaggacuuuuuggagcuauugcaggcuucauugaaggaggauggacuggaaugauugaugggugguauggcuaccaucaugaaaauucucaaggcucaggauaugcagcugauagagaaagcacucaaaaggcuauagacggaauuacaaacaaggucaauuccaucauugauaaaaugaacacacaauuugaggcugcaggucaugaguuuucaaaccuggagagaaggauugacaacuuaaacaaaagaauggaagauggauuucuggauguuuggacauacaacgccgaacuauugguucuucuugaaaacgaaagaacacuagaccuacaugaugcaaaugugaagaaccuacaugaaaaggucaaaucacaacuaagggacaaugcuaaugaccuagggaacgggugcuuugaauuuuggcauaagugugacaaugaaugcauggagucugucaaaaaugguaccuaugacuaucccaaguaucaaaaagagaguagguuaaacagacagagaauagaaucgguaaaacuggagaacuuugauguguaucaaauccuugccauuuauaguacgguaucgagcagucuaguugugguagggcugaucauggcaaugggucuuuggauguguucaaauggcucaaugcagugcaugauauguauauaa

SEQ ID NO: 41619 - RNA, 1701 nt, Artificial Sequence
  hemagglutinin__InfluenzaA__AHJ57920
augauugcaaucauaauaauagcgauacugguagcaaccggaaaaucagacaagauaugcauuggauaucaugcaaacaauucaacaacaaagguagauacgauacuugagaaaaacguaaccgucacacacucaguugaacugcuggagaaccagaaagaagaaagauucugcaaaaucucaaacaaggccccucucgaucuaagggacugcaccauagaagguuggaucuuggggaaucccuggugcggcauauugcuugcugaccaaagcuggucauacauaguggaacggccuaaugcccggaaugggauuugcuaucccggaacauugaaugaaguagaagaauugaaggcacuuauuggaucaggagaaaggguagaaagguuugagauguuucccaaaaguacaugggcaggaguggacaccaacaguggaguaucaagugcuuguccucuuggaaauggcccaucuuucuacaggaaucuucuauggauaauaaaaaccaagucaucagaauauccaguaauuaaaggaacuuucaacaacacuggagacaagucaguucucuauuuuugggguguacaccauccuccuagcagaaaugaacaaaauguucuguaugguucuggugaucgauacguuagaaugggaacugaaagcaugaauuuugccaggagcccagaaauugcggcaagaccugcugugaauggucagagaggcagaauugauuauuucugguccauuuuaaaaccaggggaaaccuugaauguagaaucuaacgggaauuuaauagccccuugguaugcauacagauuugucaacaaggauaguagaggagccauauucagaucuaauuuaccaaucgagaacugugaugccacaugccagacugcugaaggagugauaagaaccaacaaaacauuucagaaugugagcccucuguggauuggagaaugccccaaguauguaaaaaguaagaguuuaaggcuugcaacuggacuaaggaauguuccacaaauagaaacuagagggcuuuuuggagcuauugcaggcuucauugaaggaggauggacuggaaugauugaugggugguauggcuaccaccaugaaaauucucaaggcucaggguaugcagcugauagagaaagcacccaaaaggcuacagacggaauuacaaacaaggucaauuccaucauugacaaaaugaacacacaauuugaggcuguaggucaugaguuuucaaaccuggaaagaaggauugacaaccuaaacaaaagaauggaagauggauuucuggauguuuggacauacaacgcugaacuguugguucuucuugaaaacgaaagaacacuagaccuacaugaugcaaaugugaagaaccuacaugaaagggucaaaucacaacuaagggacaaugcuaaugauuuagggaacgggugcuuugaauuuuggcauaagugugacaaugaauguauggagucugucaaaaaugauaccuaugacuaccccaaguaucaaaaggagaguagguuaaacagacagaaaauagaaucgguaagacuggagaauuuugauguguaucaaauccuugccauuuauaguacgguaucgagcagucuaguuuugguagggcugaucauggcaaugggucuuuggauguguucaaaugguucaaugcagugcaggauauguauauaa

SEQ ID NO: 41620 - RNA, 1701 nt, Artificial Sequence
  hemagglutinin__InfluenzaA__AHJ57932
augauugcacucaucauaauaacgauacugguaacaaccggaaaaucagacaagauaugcauuggauaucaugccaacaauucaacaacaaagguagauacaauacucgagaagaacguaaccgucacacacucaguagaacugcuggaaaaccagaaagaagagagauucugcagaaucucaaacaaagccccucucgaucuaaaggaguguacccuagaggguuggaucuuggggaauccccaaugcgauuuauuacuuggugaccaaagcuggucauacauaguggagcggcccaaugcccgaaaugggauuugcuacccuggaacguugaaugagguagaagaauuaagggcacuuauuggaucaggggaaggaguagagagguuugagauguuucccaaaaguacaugggcaggaguggacaccaaccgugguguaacaaguucuuguccuuuugguagugguucaucuuucuacaggaaccuccuauggauaguaaaacacaccacaucaucauauccaguaauuaaaggaacuuucagaaacacuggagacaagucaguucucuauuuuugggguguacaccauccauuugacacgaaugagcaaaauguucuguaugguucugguaaucgauacguuaggaugggaacugaaagcaugaauuuugccagggguccagaaguugcggcaaggccuguugugaauggucagagaggcagaauugauuauuucugguccauuuuaaaaccaggggaaaccuugaacauagaaucuaacgguaauuuaauagccccuugguaugcauacagguuugucaacaaagauaguaagggagccauauucagaucuaauuuaccaaucgaggacugugaugccacaugccagacuauugaaggagugauaagaaccaacaaaacauuucagaaugugagccccuuguggauaggagaaugccccaaguauguaaaaagugagagucuaaggcuugcaacuggacuaaggaauguaccacagauagaaacaagaggacuuuuuggagcuauugcaggcuucauugaaggaggauggacuggaaugauugaugggugguacggcuaucaucacgaaaauucccaaggaucaggguaugcagcugauagagaaagcacucagaaggcuauagacggaauuacaaccaaggucaauuccauaauugauaaaaugaacacucaauuugaggcuguaggucaugaauuuucaaaccuggagagaaggauugacaaucuaaacaaaagauuggaagauggauuucuggauguuuggacauacaaugcugaauuguugguucuucuugaaaacgaaagaacacuagaccuacaugaugcaaaugugaagaaucuacaugaaagggucagaucacaacuaagggacaaugcuaaugaucuagggaauggauguuucgaauuuuggcauaaaugugacaaugaauguauggagucugucagaaaugguaccuauaacuaucccaaguaucaagcugaaaguagguuaaacaaacagagaauagagucgguaaaacuggagaauuuugauguguaucaaauccucgccauuuauaguacgguaucgagcagucuaguuuugguagggcugauuuuggcaaugggucuuuggauguguucaaaugguucaaugcagugcaggauauguauauaa

SEQ ID NO: 41621 - RNA, 1701 nt, Artificial Sequence
  hemagglutinin__InfluenzaA__AHJ57943
augauugcauucauuguaauagcaacacugguagcaaccggaaaaucagacaagauaugcauuggauaucaugcaaacaauucgacaacaaagguagauacgauacuugagaagaacguaacugucacacacucaguugaacugcuggagaaccagaaagaagaaagauucugcaagaucucaaacaaggccccucucgaucuaagggauuguacccuagaggguuggaucuuggggaacccccgaugcggcauauugcuagcugaccaaagcuggucauacauaguagaacggccuaaugcccgaaaugggauuugcuauccuggaacauugaaugaagcagaagaauuaaaggcacuuauuggaucaggagaaaggguagaaagguuugagauguuucccaaaagcacauggacaggaguggacaccgaaaguggaguaucaagugcuuguccucuugguaaugguccaucuuucuacaggaaucuucuauggauaauaaaacucaagucaucagaauacccaguaaucagaggaacuuucaacaacacuggagacaagucaauucucuauuuuugggguguacaccauccuccugucacaacugaacaaaaugcucuguaugguucuggugaucgauauguuagaaugggaacugaaagcaugaauuuugccaggagcccagaaauugcggcaagaccugcugugaauggucagagaggcaggauugauuauuucugguccaucuuaaaaccaggggaaaccuugaauguagaaucuaaugggaauuuaauagccccuugguaugcauacagauuugucaacaaagauagcaaaggggccauauucagaucuaauuuaccaaucgagaacugugaugccacaugccagacuacugaaggagugauaagaaccaacaaaacauuucagaaugugagcccucuguggauuggagaaugccccaaguauguaaaaaguaaaagucuaaggcuugcuacuggacuaaggaauguuccacaaauagaaacuagaggacuuuuuggagcuauugcaggcuucauugaaggaggguggacuggaaugauugaugggugguacggcuaccaucaugaaaauucucaaggcucaggauaugcagcugauaaagaaagcacucaaaaggccauagacggaaucacaaacaaggucaauuccaucauugauaaaaugaauacacaauuugagacuguaggucaugaguuuucaaaccuggagagaaggauugacaaccuaaacaaaagaauggaagauggauuucuggauguuuggacauauaaugcugaacuguugguucuucuugaaaacgaaagaacacuagaccuacaugaugcaaauguaaagaaccugcaugaaaaggucagaucacaacuaagggacaaugcuaaugaccuagggaacggaugcuuugaauuuuggcauaaguguaacaaugaauguauggagucugucaaaaaugggaccuaugacuaucccaaauaucaaaaggagaguagguuaaauagacagaaaauagaaucgguaaaacuggagaauuuugauguguaucaaauccuugccauuuauaguacgguaucgagcagucuaguuuugguagggcugauccuggcaaugggucuuuggauguguucaaaugguucaaugcagugcaggauauguauauaa

SEQ ID NO: 41622 - RNA, 1701 nt, Artificial Sequence
  hemagglutinin__InfluenzaA__AHJ57954
augauugcauucauuguaauagcaauacuggcagcaaccggaaaaucagacaagauaugcauuggauaucaugccaacaauucaacaacaaagguagauacuauacucgaaaagaacguaacugucacacacucaguugaacuacuggagaaccagaaagaagaaagauucugcaaaaucucaaacaaggccccucucgaucuaagggauuguacccuagaggguuggaucuuggggaauccccgaugcggcauccugcuugcugaccaaagcuggucauacauaguggaacggccuaaugcccgaaaugggauuugcuacccuggaauauugaaugaagcugaagaauugaaggcacuuaucggaucaggggaaaggguagaaagguuugagauguuucccaaaaguacaugggcaggaguggacacuaacaguggggugucaagugcuuguccucuugguaauggcccaucuuucuacaggaaucuucuauggauaauaaaacaaaagucaucagcauauccaguaauuagaggaacuuucaacaacacuggagacaagucaauucucuauuuuuggggugugcaccauccuccugucacaacugaacaagaagcccuguaugguucugguaaucgauacguuagaaugggaacugaaagcaugaauuuugccaggaauccagaaauugcggcaaggccugcugugaauggucagagaggcagaaucgauuauuucugguccaucuuaaaaccaggggaaaccuugaauguagaaucuaaugggaauuuaauagccccuugguaugcauacagauuugucaacaaagauaguaaaggagccauauucagaucuaauuuaccaauugagaacugugacgccacaugccagacuacagaaggagugauaagaaccaacaaaacauuucagaaugugagcccucuguggauuggagaaugccccaaguauguaaagaguaaaagucuaagacuugcaacuggacuaaggaauguuccacaaauagaaacuagaggacuuuuuggagcuauugcaggcuucauugaaggaggauggacuggaaugauugaugggugguauggcuaccaucaugaaaauucucaaggcucaggauaugcagcugauagagaaagcacucaaaaggccauagacggaauuacaaacaaggucaauuccaucauugauaaaaugaacacacaauuugaggcuguaggccaugaguuuucaaaccuggagagaaggauugacaaccugaacaaaagaauggaagauggauuucuggauguuuggacauacaacgcggaacuauugguucuucuugaaaacgaaagaacacuagaccuacaugaugcaaaugugaagaaccuacaugaaaaggucagaucacaacuaagggacaaugcuaaugaccuagggaacgggugcuuugaauuuuggcauaagugugacaaugaauguauggagucugucaaaaaugguaccuaugacuaucccaaguaccaagcggagaguagguuaaacagacagaaaauagaaucaguaaaacuggagaacuuugauguguaucaaauccuugccauuuauaguacgguaucgagcagucuaguuuugguagggcugauaauggcaaugggucucuggauguguucaaaugguucaaugcagugcaggauauguauauaa

SEQ ID NO: 41623 - RNA, 1701 nt, Artificial Sequence
  hemagglutinin__InfluenzaA__AHJ57965
augauugcauucaucauaauaacgauacugguaacaaccggaaagucagacaagauaugcauuggauaucaugccaacaauucaacaacaaagguagauacaauacuugagaagaacguaaccgucacacacucggucgaacugcuggaaaaccagaaggaagagagauucugcaaaauuucaaacaaggccccucucgaucuaaaggaguguacccuagaggguuggaucuuggggaauccccaaugcgaccuauuacuuggugaccaaagcuggucauacauaguggaacgaccuaaugcccgaaaugggauuugcuacccuggaacauugaaugaaguagaagaauugaaggcacuuauuggaucaggagaaagaguagagagguuugagauguuucccaaaaguacaugggcaggaguggacaccaacaguggaguaacaaguucuuguucuuuugguagugguucaucuuucuacaggaaucuccuauggauaauaaaacacaccacaucaucauauccaguaauuaaaggaacuuucagaaacacuggagacaagucaguucucuauuuuugggguguacaccacccaauugacacaacugagcaaaauguucuguaugguucugguaaucgauacguuaggaugggaacugaaagcaugaauuuugccaggaguccagaaauugcggcaagaccuguugugaauggucagagaggcagaauugauuauuucugguccauuuuaaaaccaggggaaaccuugaauauagaaucuaacgggaauuuaauagccccuugguaugcauacagguuugucaacaaagauagcaagggagccauauucagaucuaauuuaccaaucgagaacugugaugccacaugccagacuauugaaggagugauaagaaccaacaaaacauuucagaaugugagccccuuauggauaggagaaugccccaaguaugugaaaagugagagucuaaggcuugcaacuggacuaaggaaugucccacaaauagaaacuagaggacuuuuuggagcuauugcaggcuucauugaaggaggauggacuggaaugauugaugggugguauggcuaucaucaugaaaauucucaaggaucaggauaugcagcugauagagaaagcacucaaagggcuauagacggaauuacaaccaaggucaauuccauaauugauaaaaugaacacacaauuugaggcuguaggucaugaguuuucaaaccuggagagaaggauugacaaccuaaacaagagaauggaagauggauuucuggauguuuggacauacaaugcugaauuguugguucuucuagaaaacgagagaacacuagaccuacaugaugcaaaugugaagaaccuacaugagagggucagaucacaacuaagggacaaugcuaaugauggagggaacggauguuuugaauuuuggcauaagugugacaaugaauguauggagucugucaagaaugguaccuaugacuaucccaaguaucaagcugagaguagaucaaacagacagagaauagaaucgguaaaacuggagaauuuugacguguaucaaauacuugccauuuauaguacgguaucgagcagucuaguggugguauggcugauucuggcaaugggucuuuggaugugugcaaaugguucaaugcagugcaggauauguauauaa

SEQ ID NO: 41624 - RNA, 1701 nt, Artificial Sequence
  hemagglutinin__InfluenzaA__AHJ57977
augauugcauucauuguaauagcaauacuggcagcaaccggaaaaucagacaagauaugcauuggauaucaugccaacaauucaacaacaaagguagauacuauacucgagaagaacguaaccgucacacacucaguugaacugcuggagaaccagaaagaagaaagauucugcaaaaucucgaacaaggccccucucgaucuaagggauuguaccauagaggguuggaucuuggggaauccccgaugcggcauauugcuugcugaccaaagcuggucauacauaguggaacggccuaaugcccgaaaugggauuugcuauccuggaacauugaaugaaguugaagaauugaaggcacuuauuggaucaggggaaaggguagaaagguuugagauguuucccaagagcacaugggcaggaguggacaccaacaguggagugucaagugcuuguccucuugguaauggcccaucuuucuacaggaaucuucuauggauaauaaaacuaaagucaucagaauacccaguaauuagaggaacuuucaacaacacuggagacaagucaauucucuauuuuugggguguacaccauccuccugucacaacugaacaagaagcucuguaugguucuggugaucgauacguuagaaugggaacugaaagcaugaauuuugccaggaguccagaaauugcggcaaggccugcugugaauggucagagaggcagaaucgauuauuucugguccaucuuaaaaccaggggaaaccuugaauguagaaucuaaugggaauuuaauagccccuugguaugcauacagauuugucaacaaagauagcaaaggagccauauucagaucuaauuuaccaaucgagaacugugaugccacaugccagacuacugaaggagugauaagaaccaacaaaacauuucagaaugugagcccucuguggauuggagaaugccccaaguauguaaaaaguaaaagucuaaggcuugcuacuggacuaaggaauguuccacaaauagaaacuagaggacuuuuuggagcuauugcaggcuucauugaaggaggguggacuggaaugauugaugggugguacggcuaccaucaugaaaauucucaaggcucaggauaugcagcugauaaagaaagcacucaaaaggccauagacggaaucacaaacaaggucaauuccaucauugauaaaaugaauacacaauuugaggcuguaggucaugaguuuucaaaccuggagagaaggauugacaaccuaaacaaaagaauggaagauggauuucuggauguuuggacauauaaugcugaacuguugguucuucuugaaaacgaaagaacacuagaccuacaugaugcaaauguaaagaaccugcaugaaaaggucagaucacaacuaagggacaaugcuaaugaccuagggaacggaugcuuugaauuuuggcauaaguguaacaaugaauguauggagucugucaaaaaugggaccuaugacuaucccaaauaucaaaaggagaguagguuaaauagacagaaaauagagucgguaaaacuggagaauuuugauguguaucaaauccuugccauuuauaguacgguaucgagcagucuaguuuugguagggcugauccuggcaaugggucuuuggauguguucaaaugguucaaugcagugcaggauauguauauaa

SEQ ID NO: 41625 - RNA, 1701 nt, Artificial Sequence
  hemagglutinin__InfluenzaA__AHJ57989
augauugcauucauuguaauagcgauacugguaacaaccggaaaaucagacaagauaugcauuggauaucaugcuaacaauucaacaacaaagguagauacaauacucgagaagaacguaaccgucacacacucaguugaacugcuggagaaccagaaagaagaaagauucugcaaaaucucgaacaaggccccucucgaucuaagagauuguacccuagaggguuggaucuuggggaauccccgaugcggcauauugcuugcugaccaaagcuggucauacauaguggaacggccuaaugcccgaaaugggauuugcuauccuggaacauugaaugaaguagaagaauugaaggcacuuauuggaucaggggaaaggguagaaagauuugagauguuucccaaaaguacaugggcaagaguggacaccgacaggggaguaucaagugcuuguccucuugguaaugguccaucuuucuacaggaaucuucuauggauaguaaaacacacgacaucagaauauccagugauuaaaggaacuuacacaaacacuggagauaagucaguucucuauuuuugggguguucaccauccuccugacacaacugaacaaaauguucuguaugguucugguaaucgauacguuagaaugggaacugaaagcaugaacuuugccaggaguccagaaauugcugcaaggccugcagugaauggucagagaggcagaauugauuauuucugguccauucuaaaaccaggggaaaccuugaauguagaaucuaaugggaauuuaauagccccuugguacgcauacagguuugucaacaaagauagcaaaggagccauauucagaucuaauuuaccaaucgagaacugugaugccaccugccagacuacugaaggagugauaagaaccaacaaaacauuucagaaugugagcccuauguggauuggagaaugccccaaguauguaaaaaguaagagucuaaggcuugcaacuggacuaaggaauguuccacaaauagaaacuagaggacuauuuggagcuauugcaggcuucauugaagggggauggacuggaaugauugaugggugguauggcuaccaucaugaaaauucucaaggcucaggauaugcagcugauagagaaagcacucaaaaggcuauagacggaauuacgaacaaggucaauuccauuauugauaaaaugaacacacaauuugaggcuguaggucaugaguuuucaaaccuggaaagaagaauugacaaccuaaacaaaagaauggaagauggauuucuggauguuuggacauacaacgcugaacuguugguucuucuugaaaacgaaagaacacuagaccuacaugauucaaaugugaagaaccuacaugaaagggucaaaucacaacugagggacaaugcuaaugaccuagggaacggaugcuuugaauuuuggcauaagugugacaaugaauguauggagucugucaaaaaugguacuuauaacuaucccaaguaucaagcugagaguagauuaaacagacagaaaauagaaucgguaaaacuggaggaguuuggcguguaucaaauccuugccauuuauaguacgguaucgagcagucuaguuuugguagggcugaucauggcaaugggucuuuggauguguucaaaugguucaaugcagugcaggauauguauauaa

SEQ ID NO: 41626 - RNA, 1701 nt, Artificial Sequence
  hemagglutinin__InfluenzaA__AHJ58001
augauugcauucauuguaauagcaauacuggcagcaaccggaaaaucagacaagauaugcauuggauaucaugccaacaauucaacaacaaagguagauacuauacucgagaagaacguaacugucacacacucaguugaacugcuggagaaccagaaagaagaaagauucugcaaaaucucaaacaaggccccucucgaucuaagggauuguacccuagaggguuggaucuuggggaauccccgaugcggcauauugcuugcugaccaaagcuggucauacauaguggaacggccuaaugcccgaaaugggauuugcuauccuggaauauugaaugaagcugaagaauugaaggcacuuaucggaucaggggaaaggguagaaagguucgagauguuucccaaaaguacaugggcaggaguggacacugacaguggagugucaagugccuguccucuugguaauggcccaucuuucuacaggaaucuucuauggauaauaaaacuaaagucaucagaauauccaguaauuagaggaacuuucaacaacacuggagacaagucaauucucuauuuuuggggugugcaccauccuccugucacaacugaacaagaagcccuguaugguucugguaaucgauacguuagaaugggaacugaaagcaugaauuuugccaggaguccagaaauugcggcaaggccugcugugaauggucagagaggcagaaucgauuauuucugguccaucuuaaaaccaggggaaaccuugaauguagaaucuaaugggaauuuaauagccccuugguaugcauacagauuugucaacaaagauaguaaaggagccauauucagaucuaauuuaccaauugagaacugugacgccacaugccagacuacugaaggagugauacgaaccaacaaaacauuucagaaugugagcccuauguggauuggagaaugccccaaguauguaaagaguaagagucuaagacuugcaacuggacuaaggaauguuccacaaauagaaacuagaggacuauuuggagcuauugcaggcuucauugaaggaggauggacuggaaugauugaugggugguauggcuaccaucaugaaaauucucaaggcucaggauaugcagcugauagagaaagcacucaaaaggccauagacggaauuacaaacaaggucaauuccaucauugauaaaaugaacacacaauuugaggcuguaggucaugaguuuucaaaccuggagagaaggauugacaaccuaaacaaaagaauggaagauggauuucuggauguuuggacauacaacgcugaacuguugguucuucuugaaaacgaaagaacacuagaccuacaugaugcaaaugugaagaaccuacaugaaaaggucagaucacaacuaagggacaaugcuaaugaccuagggaacgggugcuuugaauuuuggcauaagugugacaaugaauguauggagucugucaaaaaugguaccuaugacuaucccaaguaucaaacggagaguagguuaaacagacagaaaauagaaucgguaaaacuggagaacuuugauguguaucaaauccuugccauuuauaguacgguaucgagcagucuaguuuugguagggcugaucauggcaaugggucuuuggauguguucaaaugguucaaugcagugcaggauauguauauaa

SEQ ID NO: 41627 - RNA, 1701 nt, Artificial Sequence
  hemagglutinin__InfluenzaA__AHJ58013
augauugcauucauuguaauagcgauacugguaacaaccggaaaaucagacaagauaugcauuggauaucaugcuaacaauucaacaacgaaaguagauacuauacucgagaagaacguaaccgucacacacucggucgaacugcuggagaaccaaaaagaagaaagguucugcaaaaucucaagcaaggccccucucgaucuaagggauuguucccuagaggguuggaucuuggggaauccccgaugcggcauauugcucgcugaccaaagcuggucauacauaguggaaaggccuaaugcccgaaaugggauuugcuauccuggaacauugaaugaaguagaagaauugaaggcacuuauuggaucaggggaaagaguagaaagauuugagauguuucccaaaaguacaugggcagggguggacaccaacaguggaguaucaagugcuuguccucuuggugaagguccaucuuucuacaggaaucuucuauggauaauaaaacgcacgacaucagaauauccaguaauuaaaggaacuuacagaaacacuggagauaagucaguucucuauuuuuggggugugcaccauccuccugacacaacugaacagaauguucuguacgguucugguaaucgauacguuagaaugggaacugaaagcaugaauuuugccaggagcccagaaauugcggcaaggccugcugugaauggucaaagaggcagaauugauuauuucugguccauuuuaaaaccaggggaaaccuuggauguagaaucuaaugggaauuuaauagccccuugguacgcauacagauuugucaacaaagagagcaaaggagccauauucagauccaauuuaccaaucgagaacugugaugccacuugccagacuacugaaggagugauaaggaccaacaaaacauuccagaaugugagcccucuguggauuggagagugccccaaguauguaaaaaguaagagucuaaggcuugcaacuggacuaaggaauguuccacaaauagaaacuagaggacuauuuggagcuauugcaggcuucauugaaggaggauggacuggaaugauugaugggugguauggcuaucaucaugaaaauucucagggcucaggauaugcagcugauaaagaaagcacccagaaggcuauagacggaauuacgaacaaggucaauuccaucauugauaaaaugaauacacaauuugaggcuguaggucaugaauuuucaacuuuagaaagaaggauugacaaccuaaacaaaagaauggaagauggauuuuuggauguuuggacauacaacgcugaacuguugguucuucuugaaaacgaaagaacacuagaccuacacgaugcaaaugugaagaaccuacaugaaagagucagaucacaacugagggacaaugcuaaugaccuagggaacggaugcuuugaauuuuggcauaagugugacaaugaauguauggagucagucaaaaaugguaccuauaacuaucccaaguaucaagcugagaguagauuaaacaaacagaaaauagaaucgguaaaacuggaggaguuuggcguguaucaaauccuugccauuuauaguacgguaucgagcagucuaguuuugguaggacugaucauggcaaugggucuuuggauguguucaaaugguucaaugcaaugcaggauauguauauaa

SEQ ID NO: 41628 - RNA, 1701 nt, Artificial Sequence
  hemagglutinin__InfluenzaA__AHJ58025
augauugcauucauuguaauagcaauacugguaacgaccggagaaucagacaagauaugcauuggauaucaugccaacaauucgacaacaaaaguagauacgauacucgaaaagaacguaaccgucacacacucaguugaacugcuggagaaccagaaagaagaaagauucugcaaaaucucaaacaaagccccucucgaucuaagggauuguaccauagaagguuggaucuuggggaauccccgaugcggcauacuucuugccgaucaaagcuggucauacauaguggaacggccuaaugcccgaaaugggauuugcuauccuggaacgcugaaugaagcagaagaauugaaggcacuuauuggaucaggggaagggguagaaagguuugagauguuucccaaaaguacaugggcaggaguggacaccaacaguggaguaucaagugcuuguccucuugguaaugguccaucuuucuacagaaaucuucuauggauaauaaaacucaagucaucagaauauccaguaauuagaggaacuuucaacaacacuggagacaagucaguucucuauuuuugggguguacaccauccuccugucacaacugaacaaaaugaucuguaugguucugguaaucgauauguuaggauggguacugaaagcaugaauuuugccagaaacccagagauugcauuaaggccugcugugaauggucagagaggcagaaucgauuauuucugguccauuuuaaaaccaggggaaaccuugaauguagaaucuaacgggaauuuaauagccccuugguaugcauacagauuugucaacaaagauaguaaaggagccauauucagaucuagcuuaccaauugaaaacugugacgccacaugccagacugcugaaggagugauaagaacaaacaaaacauuucagaaugugagcccucuguggauuggagaaugccccaaguauguaaaaaguaagagucuaaggcuugcaacuggacuaaggaauguuccacaaauagaaacuagaggacuuuuuggagcuauugcaggcuucauugaaggaggauggacuggaaugguugauggaugguauggcuaccaucaugaaaauucucaaggcucaggauaugcagcugauagagaaagcacucaaaaggcuauagacggaauuacgaauaaggucaauuccaucauugauaaaaugaacacacaauuugaggcuguggaucaugaguuuucaaaccuggagagaaggauugacaaccugaacaaaagaauggaagauggauuuuuggauguuuggacauacaacgccgaacuauugguucuucuugaaaacgaaagaacacuagaucuacaugaugcaaaugugaagaaccuacaugaaaaggucaaaucacaacuaagggauaaugcuaaugaccuagggaacggaugcuuugaauuuuggcauaagugugacaaugaauguauggagucugucaaaaaugguaccuauaacuaucccaaauaucaaaaagagaguagguuaaacagacagaaaauagaaucgguaaaacuagagaacuuugauguguaucaaauccuugccauuuauaguacgguaucgagcagucugguuuugguagggcugaucauggcaaugggucuuuggauguguucaaaugguucaaugcagugcaggauauguauauaa

SEQ ID NO: 41629 - RNA, 1701 nt, Artificial Sequence
  hemagglutinin__InfluenzaA__AHJ58037
augauugcauucaucauaauaacgauacugguaacaaccggagaaucagacaagauaugcauuggauaucaugccaacaauucaacaacaaagguagauacaauacucgagaagaacguaaccgucacacacucggucgaacugcuggaaaaccagaaggaagagagauucugcaaaauuucaaacaaggccccucucgaucuaaaggaguguacccuagaggguuggaucuuggggaacccccaaugcgaccuauuacuuggugaccaaagcuggucauacauaguggaacggccuaaugcccgaaaugggauuugcuacccuggaacauugaaugaaguagaagaauugaaggcacuuauuggaucaggggaaaggguagagagguuugagauguuucccaaaaguacaugggcaggaguggacaccaacaguggaguaacaaggucuuguccuuuugguagugguucaucuuucuacaggaaucuccuauggauaauaaaacacaccacaucaucauauccaguaauuaaaggaacuuucagaaacacuggagacaagucaguucucuauuuuugggguguacaccauccaauugacacaacugagcaaaauguucuguaugguucugguaaucgauacguuaggaugggaacugaaagcaugaauuuugccaggaguccagaaauugcggcaagaccuguugugaauggucagagaggcagaauugauuauuucugguccauuuuaaaaccaggggaaaccuugaauauagaaucuaacgggaauuuaauagccccuugguaugcauacagguuugucaacaaagauaguaagggagccauauucagaucuaauuuaccaaucgagaacugugaugccacaugccagacuauugaaggagugauaagaaccaacaaaacauuucagaaugugagccccuuguggauaggagaaugccccaaguaugugaaaagugagagucuaaggcuugcaacuggacuaaggaaugucccacaaauagaaacuagaggacuuuuuggagcuauugcaggcuucauugaaggaggauggacuggaaugauugauggaugguauggcuaucaucaugaaaauucucaaggaucaggguaugcagcugauagagaaagcacucaaagggcuauagacggaauuacaaccaaggucaauuccauaauugauaaaaugaacacacaauuugaggcuguaggucaugaauuuucaaaccuggagagaaggauugacaaccuaaacaaaagaauggaagauggauuucuggauguuuggacauacaaugcugaguuguugguucuucuugaaaacgaaagaacacuagaccuacaugaugcaaaugugaagaaccuacaugaaagggucaaaucacaauuaagggacaaugcuaaugaucuagggaacggauguuuugaauuuuggcauaagugugacaaugaauguauggagucugucaaaaaugguaccuaugacuaucccaaguaucaagcugagaguagguuaaacaaacagagaauagaaucgguaaaacuggagaauuuugacguguaucaaauacuugccauuuauaguacgguaucgagcagucuaguuuugguagggcugauuauggcaauuggucuuuggauguguucaaaugguucaaugcagugcaggauauguauauaa

SEQ ID NO: 41630 - RNA, 1701 nt, Artificial Sequence
  hemagglutinin__InfluenzaA__AHJ58049
augauugcauucauuguaauagcaauacuggcagcaaccggaaaaucagacaagauaugcauuggauaucaugccaacaauucaacaacaaagguagauacuauacucgagaagaacguaacugucacacacucaguugaacuacuggagaaccagaaagaagaaagauucugcaaaaucucaaacaaggccccucucgaucuaagggauuguacccuagaggguuggaucuuggggaauccucgaugcggcauacugcuugcugaccaaagcuggucauacauaguggaacggccuaaugcccgaaaugggauuugcuauccuggaauauuaaaugaagcugaagaauugaaggcacuuaucggaucaggggaaaggguagaaagguuugagauguuucccaaaaguacaugggcaggaguggacacugacaguggagugucaagugcuuguccucuugguaauggcccaucuuucuacaggaaucuucuauggauaauaaaacuaaagucaucagaauauccaguaauuagaggaacuuucaacaacacuggagacaagucaauucucuauuuuuggggugugcaccauccuccugucacaacugaacaagaagccuuguaugguucugguaaucgauacguuagaaugggaacugaaagcaugaauuuugccaggacuccagaaauugcggcaaggccugcugugaauggucagagaggcagaaucgauuauuucugguccaucuuaaaaccaggggaaaccuugaauguagaaucuaaugggaauuuaauagccccuugguaugcauacagauuugucaacaaagauaguaaaggagccauauucagaucuaauuuaccaauugagaacugugacgccacaugccagacuacugaaggagugauaagaaccaacaaaacauuucagaaugugagcccucuguggauuggagaaugccccaaguauguaaagaguaaaagucuaagacuugcaacuggacuaaggaauguuccacaaauagaaacuagaggacuuuuuggagcuauugcaggcuucauugaaggaggauggacuggaaugauugaugggugguauggcuaccaucaugaaaauucucaaggcucaggauaugcagcugauagagaaagcacucaaaaggccauagacggaauuacaaacaaggucaauuccaucauugauaaaaugaacacacaauuugaggcuguaggccaugaguuuucaaaccuggagagaaggauugacaaccuaaacaaaagaauggaagauggauuucuggauguuuggacauacaacgcggaacuauugguucuucuugaaaacgaaagaacacuagaccuacaugaugcaaaugugaagaaccuacaugaaaaggucagaucacaacuaagggacaaugcuaaugaccuagggaacgggugcuuugaauuuuggcauaagugugacaaugaauguauggagucugucaagaaugguaccuaugacuaucccaaguaccaagcggagaguagguuaaacagacagaaaauagaaucgguaaaacuggaaaacuuugauguguaucaaauccuugccauuuauaguacgguaucgagcagucuaguuuugguagggcugaucauggcaaugggucuuuggauguguucaaaugguucaaugcagugcaggauauguauauaa

SEQ ID NO: 41631 - RNA, 1701 nt, Artificial Sequence
  hemagglutinin__InfluenzaA__AHJ58061
augauugcauucauuguaauagcaacacugguagcaaccggaaaaucagacaagauaugcauuggauaucaugcaaacaauucgacaacaaagguagauacgauacuugagaagaacguaacugucacacacucaguugaacugcuggagaaccagaaagaagaaagauucugcaagaucucaaacaaggccccucucgaucuaagggauuguacccuagaggguuggaucuuggggaacccccgaugcggcauauugcuagcugaccaaagcuggucauacauaguagaacggccuaaugcccgaaaugggauuugcuauccuggaacauugaaugaagcagaagaauuaaaggcacuuauuggaucaggagaaaggguagaaagguuugagauguuucccaaaagcacauggacaggaguggacaccgaaaguggaguaucaagugcuuguccucuugguaaugguccaucuuucuacaggaaucuucuauggauaauaaaacucaagucaucagaauacccaguaaucagaggaacuuucaacaacacuggagacaagucaauucucuauuuuugggguguacaccauccuccugucacaacugaacaaaaugcucuguaugguucuggugaucgauauguuagaaugggaacugaaagcaugaauuuugccaggagcccagaaauugcggcaagaccugcugugaauggucagagaggcaggauugauuauuucugguccaucuuaaaaccaggagaaaccuugaauguagaaucuaaugggaauuuaauagccccuugguaugcauacagauuugucaacaaagauagcaaaggggccauauucagaucuaauuuaccaaucgagaacugugaugccacaugccagacuacugaaggagugauaagaaccaacaaaacauuucagaaugugagcccucuguggauuggagaaugccccaaguauguaaaaaguaaaagucuaaggcuugcuacuggacuaaggaauguuccacaaauagaaacuagaggacuuuuuggagcuauugcaggcuucauugaaggaggguggacuggaaugauugaugggugguacggcuaccaucaugaaaauucucaaggcucaggauaugcagcugauaaagaaagcacucaaaaggccauagacggaaucacaaacaaggucaauuccaucauugauaaaaugaauacacaauuugaggcuguaggucaugaguuuucaaaccuggagagaaggauugacaaccuaaacaaaagaauggaagauggauuucuggauguuuggacauauaaugcugaacuguugguucuucuugaaaacgaaagaacacuagaccuacaugaugcaaauguaaagaaccugcaugaaaaggucagaucacaacuaagggacaaugcuaaugaccuagggaacggaugcuuugaauuuuggcauaaguguaacaaugaauguauggagucugucaaaaaugggaccuaugacuaucccaaauaucaaaaggagaguagguuaaauagacagaaaauagagucgguaaaacuggagaauuuugauguguaucaaauccuugccauuuauaguacgguaucgagcagucuaguuuugguagggcugauccuggcaaugggucuuuggauguguucaaaugguucaaugcagugcaggauauguauauaa

SEQ ID NO: 41632 - RNA, 1701 nt, Artificial Sequence
  hemagglutinin__InfluenzaA__AHJ58084
augauugcauucauuguaauagcaacacugguagcaaccggaaaaucagacaagauaugcauuggauaucaugcaaacaauucgacaacaaagguagauacgauacuugagaagaacguaacugucacacacucaguugaacugcuggagaaccagaaagaagaaagauucugcaagaucucaaacaaggccccucucgaucuaagggauuguacccuagaggguuggaucuuggggaacccccgaugcggcauauugcuagcugaccaaagcuggucauacauaguagaacggccuaaugcccgaaaugggauuugcuauccuggaacauugaaugaagcagaagaauuaaaggcacuuauuggaucaggagaaaggguagaaagguuugagauguuucccaaaagcacauggacaggagugaacaccgaaaguggaguaucaagugcuuguccucuugguaaugguccaucuuucuacaggaaucuucuauggauaauaaaacucaagucaucagaauacccaguaaucagaggaacuuucaacaacacuggagacaagucaauucucuauuuuugggguguacaccauccuccugucacaacugaacaaaaugcucuguaugguucuggugaucgauauguuagaaugggaacugaaagcaugaauuuugccaggagcccagaaauugcggcaagaccugcugugaauggucagagaggcaggauugauuauuucugguccaucuuaaaaccaggggaaaccuugaauguagaaucuaaugggaauuuaauagccccuugguaugcauacagauuugucaacaaagauagcaaaggggccauauucagaucuaauuuaccaaucgagaacugugaugccacaugccagacuacugaaggagugauaagaaccaacaaaacauuucagaaugugagcccucuguggauuggagaaugccccaaguauguaaaaaguaaaagucuaaggcuugcuacuggacuaaggaauguuccacaaauagaaacuagaggacuuuuuggagcuauugcaggcuucauugaaggaggguggacuggaaugauugaugggugguacggcuaccaucaugaaaauucucaaggcucaggauaugcagcugauaaagaaagcacucaaaaggccauagacggaaucacaaacaaggucaauuccaucauugauaaaaugaauacacaauuugaggcuguaggucaugaguuuucaaaccuggagagaaggauugacaaccuaaacaaaagaauggaagauggauuucuggauguuuggacauauaaugcugaacuguugguucuucuugaaaacgaaagaacacuagaccuacaugaugcaaauguaaagaaccugcaugaaaaggucagaucacaacuaagggacaaugcuaaugaccuagggaacggaugcuuugaauuuuggcauaaguguaacaaugaauguauggagucugucaaaaaugggaccuaugacuaucccaaauaucaaaaggagaguagguuaaauagacagaaaauagaaucgguaaaacuggagaauuuugauguguaucaaauccuugccauuuauaguacgguaucgagcagucuaguuuugguagggcugauccuggcaaugggucuuuggauguguucaaaugguucaaugcagugcaggauauguauauaa

SEQ ID NO: 41633 - RNA, 1701 nt, Artificial Sequence
  hemagglutinin__InfluenzaA__AHL80708
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaggcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucugaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccagaaaggcaacauuaggugcaacauuugcauuuga

SEQ ID NO: 41634 - RNA, 1701 nt, Artificial Sequence
  hemagglutinin__InfluenzaA__AHL80718
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagauaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaucauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagacacaucaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 41635 - RNA, 1710 nt, Artificial Sequence
  hemagglutinin__InfluenzaA__AHL80729
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuugggugaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucaccagccucccauuucagaauguacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuagacauuuggacuuacaaugccgaacuguugguucuauuggaaaaugaaagaacuuuggacuaccacgauucaaaugugaagaacuuauaugaaaagguaagaagccaauuaaaaaacaaugccaaggaaauuggaaacgguugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 41636 - RNA, 1701 nt, Artificial Sequence
  hemagglutinin__InfluenzaA__AHL80740
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaauuacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcguucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 41637 - RNA, 1701 nt, Artificial Sequence
  hemagglutinin__InfluenzaA__AHL80751
augaaggcaauacuaguaguucugcuauauacauuugcaaccgcaaaugcagacacauuauguauagguuaucaugcgaacaauucaacagacacuguagacacaauacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaagggaaauucauacccaaagcucagcaaauccuacauuaaugauaaagggaaagaaauccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaaaaaaugcuggaucugguauuaucauuucagauacaccaguccacgauugcaauacaacuugucagacacccaagggugcuauaaacaccagccucccauuucagaauauacacccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaguuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 41638 - RNA, 1701 nt, Artificial Sequence
  hemagglutinin__InfluenzaA__AHL80762
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcugcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggauacuaguagagccgggagacaaaauaacauucgaagcaaccggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaagacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 41639 - RNA, 1701 nt, Artificial Sequence
  hemagglutinin__InfluenzaA__AHL80784
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagacuucaucgauuaugaggagcuaagagagcaauugagcucagugucaucauuugaaagguuugagauauuccccaagacaaguucauggcccaaucaugacucgaacaaagguauaacggcagcauguccucaugcuggagcaaaaagcuucuacaaaaauuuaauauggcuaguuaaaaaaggaaauucauauccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccaggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguuaguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 41640 - RNA, 1701 nt, Artificial Sequence
  hemagglutinin__InfluenzaA__AHL80795
augaaggcaauacuaguaguucugcuauauacauuugcaaccgcaaaugcggacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagccucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauacgcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 41641 - RNA, 1701 nt, Artificial Sequence
  hemagglutinin__InfluenzaA__AHL80817
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaacuguaacauugcuggcuggauccuggggaauccagagugugaaucacucuccacagcaagcucaugguccuacauuguggaagcaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 41642 - RNA, 1701 nt, Artificial Sequence; identical to SEQ ID NO: 41641
  hemagglutinin__InfluenzaA__AHL80828

SEQ ID NO: 41643 - RNA, 1701 nt, Artificial Sequence
  hemagglutinin__InfluenzaA__AHL80839
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagacuucaucgauuaugaggagcuaagagagcaauugagcucagugucaucauuugaaagguuugagauauuccccaagacaaguucauggcccaaucaugacucgaacaaagguauaacggcagcauguccucaugcuggagcaaaaagcuucuacaaaaauuuaauauggcuaguuaaaaaaggaaauucauauccaaagcucagcagauccuacauuaaugauaaagggaaagaaguccucgugcuauggggcauucaccauccaucuacuagugcugaccaacaaagucucuaucagaaugcagaugcauauguuuuuguagggacaucaagauacagcaagaaguucaagccggaaauagcaauaagacccaaagugagggaucaagaagggagaaugaacuauuacuggacacuaguagagccaggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguuaguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 41644 - RNA, 1701 nt, Artificial Sequence
  hemagglutinin__InfluenzaA__AHL80861
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaaggaagaaugaacuauuacuggacacuaguagagccgggagacaaaauaacauucgaagcaacuggaaaucuagugguaccgagauacgcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuuuauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagggaauuuaaauaaaaaaguugaugaugguuuccuggacauuuggacuuacaaugccgagcuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 41645 - RNA, 1701 nt, Artificial Sequence
  hemagglutinin__InfluenzaA__AHL80872
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuaaugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauacgcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuuuauugaagggggguggacagggaugguagauggaugguacgguuaucaccaucaaaaugagcagggaucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgagcuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 41646 - RNA, 1701 nt, Artificial Sequence
  hemagglutinin__InfluenzaA__AHL80883
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcacaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauacgcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuuuauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgagcuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuga

SEQ ID NO: 41647 - RNA, 1701 nt, Artificial Sequence
  hemagglutinin__InfluenzaA__AHL80894
augaaggcaauacuaguaguucugcuauauacauuugcaaccgcaaaugcggacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaucaacaaagccucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauacgcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 41648 - RNA, 1701 nt, Artificial Sequence
  hemagglutinin__InfluenzaA__AHL80905
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucguguuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauacgcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuuuauugaagggggguggacagggaugguagauggaugguaugguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgagcuguugguucuauuggaaaaugaaagaaccuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 41649 - RNA, 1701 nt, Artificial Sequence
  hemagglutinin__InfluenzaA__AHL80916
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuaccacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucaguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 41650 - RNA, 1701 nt, Artificial Sequence
  hemagglutinin__InfluenzaA__AHL80927
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucugaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41651 - RNA, 1701 nt, Artificial Sequence; identical to SEQ ID NO: 37484
  hemagglutinin__InfluenzaA__AHL80946

SEQ ID NO: 41652 - RNA, 1701 nt, Artificial Sequence
  hemagglutinin__InfluenzaA__AHL80958
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagauaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaucauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagacacaucaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuaccccaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 41653 - RNA, 1701 nt, Artificial Sequence
  hemagglutinin__InfluenzaA__AHL81001
augaagacuaucauugcuuugagcuacauucuaugucugauuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaauuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41654 - RNA, 1701 nt, Artificial Sequence
  hemagglutinin__InfluenzaA__AHL81013
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggauggcugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaauuguuugaaaaaacaaagaagcaacugagggaaaaugcugaggauaugggcaaugguuguuucaaaauauaccacaaaugugacaaugccugcauaggaucaaucagaaaugggacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41655 - RNA, 1701 nt, Artificial Sequence; identical to SEQ ID NO: 37484
  hemagglutinin__InfluenzaA__AHL81025

SEQ ID NO: 41656 - RNA, 1701 nt, Artificial Sequence
  hemagglutinin__InfluenzaA__AHL81037
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuauuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaggcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucugaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccagaaaggcaacauuaggugcaacauuugcauuuga

SEQ ID NO: 41657 - RNA, 1701 nt, Artificial Sequence; identical to SEQ ID NO: 41633
  hemagglutinin__InfluenzaA__AHL81049

SEQ ID NO: 41658 - RNA, 1701 nt, Artificial Sequence; identical to SEQ ID NO: 41652
  hemagglutinin__InfluenzaA__AHL81061

SEQ ID NO: 41659 - RNA, 1701 nt, Artificial Sequence; identical to SEQ ID NO: 41652
  hemagglutinin__InfluenzaA__AHL81072

SEQ ID NO: 41660 - RNA, 1701 nt, Artificial Sequence; identical to SEQ ID NO: 38865
  hemagglutinin__InfluenzaA__AHL81083

SEQ ID NO: 41661 - RNA, 1701 nt, Artificial Sequence
  hemagglutinin__InfluenzaA__AHL81095
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacagcccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcaccuauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaaaggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41662 - RNA, 1701 nt, Artificial Sequence
  hemagglutinin__InfluenzaA__AHL81118
augaaggcaauacuaguaguucugcuauauacauuugcaaccgcaaaugcagacacauuauguauagguuaucaugcgaacaauucaacagacacuguagacacgguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaauucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 41663 - RNA, 1701 nt, Artificial Sequence; identical to SEQ ID NO: 41633
  hemagglutinin__InfluenzaA__AHL81129

SEQ ID NO: 41664 - RNA, 1701 nt, Artificial Sequence; identical to SEQ ID NO: 41656
  hemagglutinin__InfluenzaA__AHL81141

SEQ ID NO: 41665 - RNA, 1701 nt, Artificial Sequence; identical to SEQ ID NO: 39979
  hemagglutinin__InfluenzaA__AHL81153

SEQ ID NO: 41666 - RNA, 1701 nt, Artificial Sequence
  hemagglutinin__InfluenzaA__AHL81165
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaacgcuacugagcugguucagaguuccucagcaggugaaauaugcgacaguccucaucagauccuugauggagaaaacugcacacuaauagaugcucuauugggagacccucagugugauggcuuccaaaauaagaaaugggaccuuuuuguugaacgaagcagagccuacagcaacuguuacccuuaugaugugccggauuaugccucccuuaggucacugguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcgacaggaaugcgaaauguaccagagaaacaaacuagaggcauauucggcgcaauagcggguuucauagaaaaugguugggagggaaugauggaugguugguacgguuucaggcaucaaaauucugagggaagaggacaagcagcagaucucaaaagcacucaagcagcaaucgaucaaaucaauggaaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41667 - RNA, 1701 nt, Artificial Sequence
  hemagglutinin__InfluenzaA__AHL81177
augaagacuaucauugcuuugagcuacauucuaugucugguuuucgcucaaaaacuuccuggaaaugacaacagcacggcaacgcugugucuugggcaccaugcaguaccaaacggaacgauagugaaaacaaucacgaaugaccaaauugaaguuacuaacgcuacugagcugguucagaguuccucagcaggugaaauaugcgacaguccucaucagauccuugauggagaaaacugcacacuaauagaugcucuauugggagacccucagugugauggcuuccaaaauaagaaaugggaccuuuuuguugaacgaagcagagccuacagcaacuguuacccuuaugaugugccggauuaugccucccuuaggucacugguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcgacaggaaugcgaaauguaccagagaaacaaacuagaggcauauucggcgcaauagcggguuucauagaaaaugguugggagggaaugauggaugguugguacgguuucaggcaucaaaauucugagggaagaggacaagcagcagaucucaaaagcacucaagcagcaaucgaucaaaucaauggaaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41668 - RNA, 1701 nt, Artificial Sequence; identical to SEQ ID NO: 41653
  hemagglutinin__InfluenzaA__AHL81189

SEQ ID NO: 41669 - RNA, 1701 nt, Artificial Sequence
  hemagglutinin__InfluenzaA__AHL81212
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaaaaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaagaccuugagaaauauguugaggacacuaaaauagaucucuggucauacaacgcggagcuucuuguugcccuggagaaccaacacacaauugaucuaacugacucagaaaugaacaaauuguuugaaaaaacaaaaaagcaacuaagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41670 - RNA, 1701 nt, Artificial Sequence
  hemagglutinin__InfluenzaA__AHL81224
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuaccacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaacugcuggaucugguauuaucauuucagauacaccaguccacgauugcaauacaacuugucagacacccaagggugcuauaaacaccagccucccauuucagaauauacauccgaucacaauuggaaaauguccaaaauaugugaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucaguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 41671 - RNA, 1701 nt, Artificial Sequence; identical to SEQ ID NO: 41633
  hemagglutinin__InfluenzaA__AHL81235

SEQ ID NO: 41672 - RNA, 1701 nt, Artificial Sequence; identical to SEQ ID NO: 41633
  hemagglutinin__InfluenzaA__AHL81247

SEQ ID NO: 41673 - RNA, 1701 nt, Artificial Sequence; identical to SEQ ID NO: 41633
  hemagglutinin__InfluenzaA__AHL81259

SEQ ID NO: 41674 - RNA, 1701 nt, Artificial Sequence; identical to SEQ ID NO: 41633
  hemagglutinin__InfluenzaA__AHL81271

SEQ ID NO: 41675 - RNA, 1701 nt, Artificial Sequence; identical to SEQ ID NO: 41633
  hemagglutinin__InfluenzaA__AHL81283

SEQ ID NO: 41676 - RNA, 1701 nt, Artificial Sequence; identical to SEQ ID NO: 41633
  hemagglutinin__InfluenzaA__AHL81295

SEQ ID NO: 41677 - RNA, 1701 nt, Artificial Sequence; identical to SEQ ID NO: 41652
  hemagglutinin__InfluenzaA__AHL81307

SEQ ID NO: 41678 - RNA, 1701 nt, Artificial Sequence
  hemagglutinin__InfluenzaA__AHL81329
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguucacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgagcuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 41679 - RNA, 1701 nt, Artificial Sequence
  hemagglutinin__InfluenzaA__AHL81340
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacauuggaauuuaacaaugaaagcuucaauuggacuggagucacucaagacggaacaagcucugcuugcauaaggggaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaagcugcaaucccgaauaucggaucuagacccagaguaaggaacauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaacgguuucagaucaagggaauugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41680 - RNA, 1701 nt, Artificial Sequence; identical to SEQ ID NO: 41633
  hemagglutinin__InfluenzaA__AHL81352

SEQ ID NO: 41681 - RNA, 1701 nt, Artificial Sequence
  hemagglutinin__InfluenzaA__AHL81364
augaaggcaauacuaguaguucugcuauauacauuugcaaccgcaaaugcagacacauuauguauagguuaucaugcgaacaauucaacagacacuguagacacgguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggagcguguuacccaggagauuucaucaauuaugaggagcuaagagagcaauugagcucagugucaucauuugaaagguuugagauauuccccaagacaaauucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 41682 - RNA, 1701 nt, Artificial Sequence
  hemagglutinin__InfluenzaA__AHL81386
augaaggcaauacuaguaguucugcuauauacauuugcaaccgcaaaugcagacacauuauguauagguuaucaugcgaacaauucaacagacacuguagacacgguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaauucauggcccaaucaugacucgaacaaagguguaacggcagcauguccucaugcuggaguaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugccauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaagggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 41683 - RNA, 1701 nt, Artificial Sequence; identical to SEQ ID NO: 41633
  hemagglutinin__InfluenzaA__AHL81397

SEQ ID NO: 41684 - RNA, 1701 nt, Artificial Sequence; identical to SEQ ID NO: 41669
  hemagglutinin__InfluenzaA__AHL81409

SEQ ID NO: 41685 - RNA, 1701 nt, Artificial Sequence
  hemagglutinin__InfluenzaA__AHL81419
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagacuucaucgauuaugaggagcuaagagagcaauugagcucagugucaucauuugaaagguuugagauauuccccaagacaaguucauggcccaaucaugacucgaacaaagguauaacggcagcauguccucaugcuggagcaaaaagcuucuacaaaaauuuaauauggcuaguuaaaaaaggaaauucauauccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccaggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguuaguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 41686 - RNA, 1701 nt, Artificial Sequence; identical to SEQ ID NO: 41646
  hemagglutinin__InfluenzaA__AHL81430

SEQ ID NO: 41687 - RNA, 1701 nt, Artificial Sequence; identical to SEQ ID NO: 31139
  hemagglutinin__InfluenzaA__AHL88951

SEQ ID NO: 41688 - RNA, 1701 nt, Artificial Sequence
  hemagglutinin__InfluenzaA__AHL89030
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacccaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuucuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41689 - RNA, 1701 nt, Artificial Sequence
  hemagglutinin__InfluenzaA__AHL89042
augaagacuaucauugcuuugagcuacauucuaugucugguuuucgcucaaaagcuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggggacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaaacuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuggugggguucaucaugugggccugccaaaaaggcaacauuaggugcaacauuugcauuuga

SEQ ID NO: 41690 - RNA, 1701 nt, Artificial Sequence
  hemagglutinin__InfluenzaA__AHL89054
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaguuggcaacagggaugcgaaauguaccagagaaacaaacuagaggcauauuuggcgcaaucgcagguuucauagaaaaugguugggagggaaugguggaugguugguacgguuucagacaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacuuagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccaugucauguuuuuugcuuuguguugcuuuguugggguucaucaugugggccugccaaaaaggcaacauuaggugcaacauuugcauuuga

SEQ ID NO: 41691 - RNA, 1701 nt, Artificial Sequence
  hemagglutinin__InfluenzaA__AHL89066
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuugucgaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagacugaauugguuaacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagaccuagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacagaaucacauauggggccugucccagauauguuaagcaaaacacucugaaauuggcaacagggaugagaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 41692 - RNA, 1701 nt, Artificial Sequence
  hemagglutinin__InfluenzaA__AHL89078
augaagacuaucauugcuuugagcuacauucuaugucugguuuucgcucaaaaacuucccggagaugacaacagcacggcaacgcugugccuugggcaccaugcaguaccaaacggaacgguagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaagaagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauauuggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucaccccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41693 - RNA, 1701 nt, Artificial Sequence
  hemagglutinin__InfluenzaA__AHL89090
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccuuaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggacuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41694 - RNA, 1701 nt, Artificial Sequence
  hemagglutinin__InfluenzaA__AHL89102
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaaccagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcuaaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41695 - RNA, 1701 nt, Artificial Sequence; identical to SEQ ID NO: 31139
  hemagglutinin__InfluenzaA__AHL89114

SEQ ID NO: 41696 - RNA, 1701 nt, Artificial Sequence
  hemagglutinin__InfluenzaA__AHL89126
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaaacuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41697 - RNA, 1701 nt, Artificial Sequence
  hemagglutinin__InfluenzaA__AHL89138
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacagcccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaaucaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaggggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41698 - RNA, 1701 nt, Artificial Sequence
  hemagglutinin__InfluenzaA__AHL89150
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacaggaaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugguguucaucaugugggccugccagaagggcaacauuaggugcaacauuugcauuuga

SEQ ID NO: 41699 - RNA, 1701 nt, Artificial Sequence
  hemagglutinin__InfluenzaA__AHL89162
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauuaggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaauguaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaacaggacaagcagcagaucucaaaagcacucaagcagcaaccaaucaaaucaaugggaagcugaauagguugaucgggaaaaccaacgagaaauuccaucagauugaaaaagaauucucagaaguagaagggagaauucaggaccucgagaaauauguugaggacaccaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41700 - RNA, 1701 nt, Artificial Sequence
  hemagglutinin__InfluenzaA__AHL89174
augaagacuaucauugcuuugagcuacacucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacucuaauagaugcucuauugggagacccucagugugauggcuuccaaaauaagaaaugggaccuuuuuguugaacgcagcaaagccuacagcaacuguuacccuuaugaugugccagauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaggaauucucagaaguagaagggagaauucaggaccucgagaaauauguugaggacacuaaaauagaucucuggucauacaacgcggagcuucuuguugcccuggagaaccaacacacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41701 - RNA, 1701 nt, Artificial Sequence
  hemagglutinin__InfluenzaA__AHL89210
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugaguugguucagaguuccucaacaggugaaauaugcgacaguccucaucagauccuugauggagaaaacugcacacuaauagaugcucuauugggagacccccagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacucacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggugacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaggggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggguacaaagauuggauccuauggauuuccuuugccauaucauguuuuuugcuuuguguugcuuuauugggguucaucaugugggccugccaaaaaggcaacauuaggugcaacauuugcauuuga

SEQ ID NO: 41702 - RNA, 1701 nt, Artificial Sequence
  hemagglutinin__InfluenzaA__AHL89222
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacagcccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaggggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41703 - RNA, 1701 nt, Artificial Sequence
  hemagglutinin__InfluenzaA__AHL89234
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcccaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaagccauuucaaaauguaaacaggaucacauauggggccugucccagauauguuaagcaaaacacucugaaauuggcaacagggaugcgaaauguaccagagaaacaaaccagaggcauauuuggcgcaaucgcggguuucauagaaaaugguugggagggaaugguggaugguugguacgguuucaggcaucaaaauucugagggaaugggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41704 - RNA, 1701 nt, Artificial Sequence
  hemagglutinin__InfluenzaA__AHL89246
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacagcccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcgggcuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaggggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaauguggcaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41705 - RNA, 1701 nt, Artificial Sequence
  hemagglutinin__InfluenzaA__AHL89258
augaagacuaucauugcuuugagcuacauucuaugucugguuuucgcucaaaaacuucccggaaaugacaacagcacggcaacgcugugccuugggcaccaugcaguaccaaacggaacgauaguaaaaacaaucacgaaugaccaaauugaaguuacuaaugccacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauaccaagcauugaacgugacuaugccaaacaaugaaaaauuugacaaauuauacauuugggggguucaccacccggguacggacaaugaccaaaucuuccuguaugcucaagcaucaggaagaaucacagucucuaccaaaagaagccaacaaacuguaaucccgaauaucggaucuagaccuagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacagaaucacauauggggccugucccagauauguuaagcaaaacacucugaaauuggcaacagggaugagaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 41706 - RNA, 1701 nt, Artificial Sequence
  hemagglutinin__InfluenzaA__AHL89270
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacagcccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcgggcuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaggggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41707 - RNA, 1701 nt, Artificial Sequence; identical to SEQ ID NO: 41706
  hemagglutinin__InfluenzaA__AHL89282

SEQ ID NO: 41708 - RNA, 1701 nt, Artificial Sequence; identical to SEQ ID NO: 41706
  hemagglutinin__InfluenzaA__AHL89294

SEQ ID NO: 41709 - RNA, 1701 nt, Artificial Sequence; identical to SEQ ID NO: 41706
  hemagglutinin__InfluenzaA__AHL89306

SEQ ID NO: 41710 - RNA, 1701 nt, Artificial Sequence
  hemagglutinin__InfluenzaA__AHL89318
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugaacugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagacugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagaccuagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaaugguagcauucccaaugacaaaccauuucaaaauguaaacagaaucacauauggggccugucccagauauguuaagcaaaacacucugaaauuggcaacagggaugagaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaagggcguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 41711 - RNA, 1701 nt, Artificial Sequence
  hemagglutinin__InfluenzaA__AHL89330
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacagcccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaggggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41712 - RNA, 1701 nt, Artificial Sequence; identical to SEQ ID NO: 31139
  hemagglutinin__InfluenzaA__AHL89342

SEQ ID NO: 41713 - RNA, 1701 nt, Artificial Sequence; identical to SEQ ID NO: 32065
  hemagglutinin__InfluenzaA__AHL89354

SEQ ID NO: 41714 - RNA, 1701 nt, Artificial Sequence
  hemagglutinin__InfluenzaA__AHL89366
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacaguaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagacugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagaccuagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugaaaucagaugcacccauuggcaaaugcaauucugaaugcaucacuccaaaugguagcauucccaaugacaaaccauuucaaaauguaaacagaaucacauauggggccugucccagauauguuaagcaaaacacucugaaauuggcaacagggaugagaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaagggcauugagcugaagucaggauacaaagauuggauccuauggauuuccuuugccauaucauguuuuuugcuuuguguuguuuuguugggguucaucaugugggccugccaaaaaggcaauauuaggugcaacauuugcauuuga

SEQ ID NO: 41715 - RNA, 1701 nt, Artificial Sequence
  hemagglutinin__InfluenzaA__AHL89378
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacagcccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcgggcuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaggggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41716 - RNA, 1701 nt, Artificial Sequence
  hemagglutinin__InfluenzaA__AHL89390
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucgggucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41717 - RNA, 1701 nt, Artificial Sequence; identical to SEQ ID NO: 41706
  hemagglutinin__InfluenzaA__AHL89402

SEQ ID NO: 41718 - RNA, 1701 nt, Artificial Sequence
  hemagglutinin__InfluenzaA__AHL89414
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuggauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagacugaauugguugacccacuuaaaauucaaauacccagcauugaacgugacuaugccaaacaaugaaaaauuugacaaauuguacauuugggggguucaccacccggguacggacaaugaccaaaucuucuuguaugcucaagcaucaggaagaaucacagucucuaccaaaagaagccaacaaacuguaaucccgaauaucggauccagaccuagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacagaaucacauauggggccugucccagauauguuaagcaaaacacucugaaauuggcaacagggaugagaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 41719 - RNA, 1701 nt, Artificial Sequence
  hemagglutinin__InfluenzaA__AHL89426
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagacugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagaccuagaguaaggaauauccccagcagaauaagcaucuauuggacaauaguaaaaccgggagacauacuuuuuauuaacagcacagggaaucuaauugcuccuagggguuacuucaaaauacgaagugggaaaagcucaauaaugagaucagaugcacccauuggcaaaugcaauucugaaugcaucacuccaaaugguagcauucccaaugacaaaccauuucaaaauguaaacagaaucacauauggggccugucccagauauguuaagcaaaacacucugaaauuggcaacagggaugagaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaagggcguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 41720 - RNA, 1701 nt, Artificial Sequence
  hemagglutinin__InfluenzaA__AHL89438
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcuuuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaaucgcuccuagggguuacuucaaaauacgaagugggaaaagcucaauaaugagaucagaugcacccaucggcaaaugcaauucugaaugcaucacuccaaauggaagcauucccaaugacaaaccauuucaaaauguaaacagaaucacauauggggccuguccccgauauguuaaacaaaacacucugaaauuggcaacagggaugagaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaaguacucaagcagcaaucaaucaaaucaaugggaagcugaauagguugaucgggaaaaccaacgagaaauuccaucagauugaaaaagaauucucagaaguagaagggagaauccaggaccucgagaaauauguugaggacacuaaaauagaucucuggucauacaacgcggagcuucuuguugcccuggagaaccaacauacaauugaucuaacugacucagaaaugaacaaacuauuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41721 - RNA, 1701 nt, Artificial Sequence; identical to SEQ ID NO: 41720
  hemagglutinin__InfluenzaA__AHL89450

SEQ ID NO: 41722 - RNA, 1701 nt, Artificial Sequence
  hemagglutinin__InfluenzaA__AHL89462
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacagcccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaggggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41723 - RNA, 1701 nt, Artificial Sequence
  hemagglutinin__InfluenzaA__AHL89474
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacagcccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugauguaccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcgggcuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaggggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41724 - RNA, 1701 nt, Artificial Sequence; identical to SEQ ID NO: 41716
  hemagglutinin__InfluenzaA__AHL89486

SEQ ID NO: 41725 - RNA, 1701 nt, Artificial Sequence
  hemagglutinin__InfluenzaA__AHL89498
augaagacuaucauugcuuugagcuacauucuaugucugguuuuugcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucaucaggcacacuggaguuuaacaaugaaagcuucaauuggacuggagucacucaaaauggaacaagcucugcuugcaaaaggagaucuaauaacaguuucuuuaguagacugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagaccuagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaaugguagcauucccaaugacaaaccauuucaaaauguaaacagaaucacauauggggccugucccagauauguuaagcaaaacacucugaaauuggcaacagggaugagaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaagggcguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 41726 - RNA, 1701 nt, Artificial Sequence; identical to SEQ ID NO: 41725
  hemagglutinin__InfluenzaA__AHL89510

SEQ ID NO: 41727 - RNA, 1701 nt, Artificial Sequence; identical to SEQ ID NO: 41725
  hemagglutinin__InfluenzaA__AHL89522

SEQ ID NO: 41728 - RNA, 1701 nt, Artificial Sequence
  hemagglutinin__InfluenzaA__AHL89534
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagacugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagaccuagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaaugguagcauucccaaugacaaaccauuucaaaauguaaacagaaucacauauggggccugucccagauauguuaagcaaaacacucugaaauuggcaacagggaugagaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaagggcauugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 41729 - RNA, 1698 nt, Artificial Sequence
  hemagglutinin__InfluenzaA__AHL89546
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuuacuauggcugacggggaagaaugguuuguauccaaaucugagcaaguccuaugcaaacaacaaagagaaagaaguccuuguacugugggguguucaucacccgccuaacauaggggaccaaagggcccucuaucauacagaaagugcuuaugucucuguagugucuucacauuauagcagaagauucaccccagaaauagccaaaagacccaagguaagagaucaggaaggaagaaucaacuacuacuggacucugcuggagcccggggauacaauaauauuugaggcaaauggaaaucuaauagcgccaagguuugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagagaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 41730 - RNA, 1698 nt, Artificial Sequence; identical to SEQ ID NO: 32465
  hemagglutinin__InfluenzaA__AHL89558

SEQ ID NO: 41731 - RNA, 1698 nt, Artificial Sequence
  hemagglutinin__InfluenzaA__AHL89570
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagaugguugguaugguuaucaccaucaaaaugagcaaggaucuggguaugcugcugaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 41732 - RNA, 1698 nt, Artificial Sequence
  hemagglutinin__InfluenzaA__AHL89582
augaaaguaaaacuacuuguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggauauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaaugggugaaugugaugcgaagugucaaacaccucagggagcuauaaacaguagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 41733 - RNA, 1698 nt, Artificial Sequence; identical to SEQ ID NO: 41732
  hemagglutinin__InfluenzaA__AHL89594

SEQ ID NO: 41734 - RNA, 1698 nt, Artificial Sequence; identical to SEQ ID NO: 41732
  hemagglutinin__InfluenzaA__AHL89606

SEQ ID NO: 41735 - RNA, 1698 nt, Artificial Sequence
  hemagglutinin__InfluenzaA__AHL89618
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucacuucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcugaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 41736 - RNA, 1698 nt, Artificial Sequence; identical to SEQ ID NO: 32592
  hemagglutinin__InfluenzaA__AHL89630

SEQ ID NO: 41737 - RNA, 1698 nt, Artificial Sequence
  hemagglutinin__InfluenzaA__AHL89642
augaaaguaaaacuacuuguucuguuauguacauuuacagcuacauaugcagacacaauauguauaggcuaccaugccaacaacucgaccgacacuguugacacaguacuugagaagaaugugacagugacacacucugucaaccuacuugaggacaaucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggauauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaaugggugaaugugaugcgaagugucaaacaccucagggagcuauaaacaguagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgaucuacucaacagucgccaguucccugguucuuuuggucucccugggggcaaucagcuucuggauguguucuaaugggucuuugcaguguagaauaugcaucuaa

SEQ ID NO: 41738 - RNA, 1698 nt, Artificial Sequence
  hemagglutinin__InfluenzaA__AHL89654
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaagggauagccccacuacaauuggguaauugcagcguugccggauggauuuuaggaaacccagaaugcgaauuacugauuuccaaggaaucaugguccuacauuguagagacaccaaauccugagaauggaacauguuacccagggaauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagccuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaguuaaagaauaaugccaaagaaauaggaaacggguguuuugaauucuaucacaaauguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 41739 - RNA, 1698 nt, Artificial Sequence
  hemagglutinin__InfluenzaA__AHL89666
augaaaguaaaacuacuuguucuguuauguacauuuacagcuacauaugcagacacaauauguauaggcuaccaugccaacaacucgaccgacacuguugacacaguacuugagaagaaugugacagugacacacucugucaaccuacuugaggacaaucacaauggaaaacuaugucuacuaaaaggaauagccccacuacaauuggguaauugcagcguugccggauggaucuuaggaaacccagaaugcgaauuauugauuuccaaggaaucaugguccuacauuguagaaacaccaaauccugagaauggaacauguuacccaggauauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaaugggugaaugugaugcgaagugucaaacaccucagggagcuauaaacaguagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccgaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgaucuacucaacagucgccaguucccugguucuuuuggucucccugggggcaaucagcuucuggauguguucuaaugggucuuugcaguguagaauaugcaucuaa

SEQ ID NO: 41740 - RNA, 1698 nt, Artificial Sequence
  hemagglutinin__InfluenzaA__AHL89678
augaaaguaaaacuacuuguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggauauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaaugggugaaugugaugcgaagugucaaacaccucagggagcuauaaacaguagucuuccuuuccagaauguacauccagucacaauaggggaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacaggaagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 41741 - RNA, 1698 nt, Artificial Sequence
  hemagglutinin__InfluenzaA__AHL89690
augaaaguaaaacuacugguccuguuaugcacauuuacagcuacauaugcagacacaauauguauaggcuaccaugccaacaacucaaccgacacuguugacacaguacuugaaaagaaugugacagugacacacucugucaaccugcuugaggacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccagauccugagaauggaacauguuacccagggcauuucgcugacuaugaggaacugagggagcaauugaguucaguaucuucauuugagagguucgaaauauuccccaaagaaagcucauggcccaaccacaccguaaccggaguaucagcaucaugcucccauaaugggaaaagcaguuuuuacaaaaacuugcuauggcugacggggaagaaugguuuguacccaaaccugagcaaguccuaugcaaacaacaaagagaaagaaguccuuguacuaugggguguucaucacccgccaaacauaggugaccaaaaggcccucuaucauacagaaaaugcuuaugucucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagagguuuuggaucaggaaucaucaauucaaaugcaccaauggauaaaugugaugcgaagugccaaacaccucagggagcuauaaacagcagucuuccuuuccagaauguacacccagucacaauaggagaguguccaaaguaugucaggagugcaaaauuaaggaugguuacaggacuaagaaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuuaaauaaaaaaguugaugauggguuuauagacauuuggacauacaaugcagagcuguugguucuacuggaaaaugaaaggacuuuggauuuccaugacuccaaugugaagaaucuguaugagaaaguaaaaagccaguuaaagaauaaugccaaagaaauaggaaauggguguuuugaauucuaucacaaguguaacgaugaaugcauggagaguguaaaaaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuga

SEQ ID NO: 41742 - RNA, 1698 nt, Artificial Sequence
  hemagglutinin__InfluenzaA__AHL89702
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccagggaauuucgccgacuaugaggagcugagagagcaauugaguucaguaucuucauuugagagguucgaaauauuccccaaagagagcucauggcccaaccacaccguaaccggaguaucagcaucaugcucccauaaugggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagccuuccuuuccagaauguacacccagucacaauaggagaguguccaaaguaugucaggagugcaaaauuaagaaugguuacagggcuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaauguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 41743 - RNA, 1698 nt, Artificial Sequence
  hemagglutinin__InfluenzaA__AHL89714
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgcugacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcauugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 41744 - RNA, 1698 nt, Artificial Sequence
  hemagglutinin__InfluenzaA__AHL89726
augaaaguaaaacuacugguucuguuauguacauuuacagcuacauaugcagacacaauauguauaggcuaccaugccaacaacucgaccgacacugucgacacaguacuugagaagaaugugacaguaacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaaaggcccucuaucauacagaaaaugcuuauguuucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcaccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacggaauuacaaacaaggugaauuccguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 41745 - RNA, 1698 nt, Artificial Sequence
  hemagglutinin__InfluenzaA__AHL89750
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggauggaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcugaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 41746 - RNA, 1698 nt, Artificial Sequence
  hemagglutinin__InfluenzaA__AHL89762
augaaaguaaaacuacugauucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuauuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuacccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 41747 - RNA, 1698 nt, Artificial Sequence; identical to SEQ ID NO: 32577
  hemagglutinin__InfluenzaA__AHL89774

SEQ ID NO: 41748 - RNA, 1698 nt, Artificial Sequence; identical to SEQ ID NO: 41742
  hemagglutinin__InfluenzaA__AHL89786

SEQ ID NO: 41749 - RNA, 1698 nt, Artificial Sequence
  hemagglutinin__InfluenzaA__AHL89798
augaaagugaaacuacugguucuguuauguacauuuacagcuacauaugcagacacaauauguauaggcuaccaugccaacaacucgaccgacacuguugacacaguacuugagaagaaugugacagugacacacucugucaaccuacuugaggaccgucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacgggaaagaaugguuuguacccaaaccugagcagauccuaugcaaacaacaaagagaaagaaguccuuguacugugggguguucaucacccgccuagcauaggggaccaaagggcccucuaucauacagaaaaugcuuaugucucuguagugucuucacauuauagcagaagauucaccccagaaauagccaaaagacccaaggugagagaucaggaaggaagaaucaauuacuacuggacucuacuggaacccggggauacaauaauauuugaggcaaaugggaaucuaauagcgccaagguuugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaaggggguuggacuggaaugguagaugguugguaugguuaucaccaccagaaugagcaaggaucuggguaugcugcagaucaaaaaagcacacaaaaugccauuaacgggauuacaaacaaggugaauucugugauugagaaaaugaacacucaauucacagcugugggcaaagaauucaacaaauuggaaagaagaauggaaaacuuaaauaaaaaaguugaugauggguuucuggacauuuggacguauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccuuguucuuuuggucucccugggggcaaucagcuucuggauguguuccaaugggucuuugcaguguagaauaugcaucuaa

SEQ ID NO: 41750 - RNA, 1698 nt, Artificial Sequence
  hemagglutinin__InfluenzaA__AHL89810
augaaaguaaaacuacuuguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggauauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaaugggugaaugugaugcggagugucaaacaccucagggagcuauaaacaguagucuuccuuuccagaauguacauccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaagagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 41751 - RNA, 1698 nt, Artificial Sequence
  hemagglutinin__InfluenzaA__AHL89822
augaaagugaaacuacugguucuguuauguacauuuacagcuacauaugcagacacaauauguauaggcuaccaugccaacaacucgaccgacacuguugacacaguacuugagaagaaugugacagugacacacucugucaaccuacuugaggaccgucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacgggaaagaaugguuuguacccaaaccugagcaaauccuaugcaaacaacaaagagaaagaaguccuuguacugugggguguucaucacccgccuaacauaggggaccaaagggcccucuaucauacagaaaaugcuuaugucucuguagugucuucacauuauagcagaagauucacuccagaaauagccaaaagacccaaggugagagaucaggaaggaagaaucaacuacuacuggacucuacuggaacccggggauacaauaauauuugaggcaaaugggaaucuaauagcgccaagguuugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaccagaaugagcaaggaucuggguaugcugcagaucaaaaaagcacacaaaaugccauuaacgggauuacaaacaaggugaauucugugauugagaaaaugaacacucaauucacagcugugggcaaagaauucaacaaauuggaaagaagaauggaaaacuuaaauaaaaaaguugaugauggauuucuagacauuuggacguauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 41752 - RNA, 1698 nt, Artificial Sequence
  hemagglutinin__InfluenzaA__AHL89834
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccagggaauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagccuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaagaauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggagacggguguuuugaauucuaucacaaauguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 41753 - RNA, 1698 nt, Artificial Sequence; identical to SEQ ID NO: 32577
  hemagglutinin__InfluenzaA__AHL89846

SEQ ID NO: 41754 - RNA, 1701 nt, Artificial Sequence; identical to SEQ ID NO: 32445
  hemagglutinin__InfluenzaA__AHL89858

SEQ ID NO: 41755 - RNA, 1701 nt, Artificial Sequence
  hemagglutinin__InfluenzaA__AHL89870
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccagauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41756 - RNA, 1701 nt, Artificial Sequence
  hemagglutinin__InfluenzaA__AHL89882
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucaucuggcacacuggaguuuaacaaugaaagcuucaauuggacgggagucacucaaaauggaacaagcucugcuugcaaaaggggaucugauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacccugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauauggguaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggcuacaaagauuggauccuauggauuuccuuugccauaucauguuuuuugcuuuguguugcuuuguugggguucaucaugugggccugccaaaaaggcaacauuaggugcaacauuugcauuuaa

SEQ ID NO: 41757 - RNA, 1701 nt, Artificial Sequence
  hemagglutinin__InfluenzaA__AHL89894
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41758 - RNA, 1701 nt, Artificial Sequence
  hemagglutinin__InfluenzaA__AHL89906
augaagacuaucauugcuuugagcuacauucuaugucugguuuacgcucaaaaacuucccggaauugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauugggcuggagucacucaaaauggaacaagcucugcuugcaaaaggggaucuaauaacaguuucuuuaguagauugaauugguugacccacucaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaggcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaccagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaagacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuucagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41759 - RNA, 1701 nt, Artificial Sequence
  hemagglutinin__InfluenzaA__AHL89918
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaccuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacaggaaaucuaauugcuccuagggguuacuucaaaauacaaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcggcaaucgaucaaaucaaugggaagcugaauagguugaucgggaaaaccaacgagaaauuccaucagauugaaaaagaguucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41760 - RNA, 1701 nt, Artificial Sequence
  hemagglutinin__InfluenzaA__AHL89930
augaagacuaucauugcuuugagcuacauucuaugucugguuuucgcucaaaaacuucccggaauugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuguugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauugggcuggagucacucaaaauggaacaagcucugcuugcaaaaggggaucuaauaacaguuucuuuaguagauugaauugguugacccacucaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauagugaaaccgggagacauacuuuugauuaacagcacagggaaucuaauugcuccuagggguuacuucaaaauacgaagugggaaaagcucaauaaugagaucagaugcacccauuagcaaaugcaauucugaaugcaucacuccaaauggaagcauucccaaugacaaaccauuucaaaauguaaacaggaucacauacggggccugucccagguauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaaugggacaagcagcagaucucaaaagcacucaagcagcaaucgaucaaaucaaugggaagcugaauagguugaucgggaaaaccaacgagaaauuccaccagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaagacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuucagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41761 - RNA, 1701 nt, Artificial Sequence
  hemagglutinin__InfluenzaA__AHL89942
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacaggaaaucuaauugcuccuagggguuacuucaaaauacaaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaguucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41762 - RNA, 1701 nt, Artificial Sequence
  hemagglutinin__InfluenzaA__AHL89954
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41763 - RNA, 1701 nt, Artificial Sequence
  hemagglutinin__InfluenzaA__AHL89966
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaagucacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41764 - RNA, 1701 nt, Artificial Sequence
  hemagglutinin__InfluenzaA__AHL89978
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaagucacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacguuacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41765 - RNA, 1701 nt, Artificial Sequence
  hemagglutinin__InfluenzaA__AHL89990
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaagucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucuaaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41766 - RNA, 1701 nt, Artificial Sequence
  hemagglutinin__InfluenzaA__AHL90002
augaagacuaucauugcuuugagcuacauucuaugucugguuuucgcucaaaaacuucccggaauugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauugggcuggagucacucaaaauggaacaagcucugcuugcaaaaggggaucuaauaacaguuucuuuaguagauugaauugguugacccacucaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagguauguuaagcagaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaaugggacaagcagcagaucucaaaagcacucaagcagcaauugaucaaaucaaugggaagcugaauagguugaucgggaaaaccaacgagaaauuccaccagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaagacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuucagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41767 - RNA, 1701 nt, Artificial Sequence
  hemagglutinin__InfluenzaA__AHL90014
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaguugaaguuacuaaugcuacugagcugguucagaguuccucaacaggugaaauaugcgacaguccucaucagauccuugauggagaaaacugcacacuaauagaugcucuauugggagacccucaaugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauauccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41768 - RNA, 1701 nt, Artificial Sequence
  hemagglutinin__InfluenzaA__AHL90026
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaguugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagauccaauaacaguuucuuuaguagauugaauugguugacccacuuaaaauucaaauauccagcauugaacgugacuaugccaaacaaugaaaaauuugacaaauuguacauuugggguguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41769 - RNA, 1701 nt, Artificial Sequence
  hemagglutinin__InfluenzaA__AHL90050
augaagacuaucauugcuuugagcuacauucuaugucugguuuucgcccaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcauuuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcauaacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacgcagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucgggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41770 - RNA, 1701 nt, Artificial Sequence
  hemagglutinin__InfluenzaA__AHL90062
augaagacuaucauugcuuugagcuacauucuaugucugguuuucgcucaaaaacuuccugaaaaugacaacagcacggcaacgcugugccuugggcaccaugcgguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaauuacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41771 - RNA, 1701 nt, Artificial Sequence
  hemagglutinin__InfluenzaA__AHL90074
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacguagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41772 - RNA, 1701 nt, Artificial Sequence
  hemagglutinin__InfluenzaA__AHL90086
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagauauaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41773 - RNA, 1701 nt, Artificial Sequence
  hemagglutinin__InfluenzaA__AHL90098
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcccuauugggagacccucagugugauggcuuccaaaauaagaaaugggaccuuuuuguugaacgcagcaaagccuacagcaacuguuacccuuaugaugugccggauuaugccucccuuaggucacuaguugccucaucuggcacacuggaguuuaacaaugaaagcuucaauuggacgggagucacucaaaauggaacaagcucugcuugcaaaaggggaucugauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauugacaaaugcaauucugaaugcaucacuccaaauggaagcauucccaaugacaaaccauuucaaaauguaaacaggaucacauauggggccugucccagauauguuaagcagaacacccugaaauuggcaacaggaaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagagaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggcuacaaagauuggauacuauggauuuccuuugccauaucauguuuuuugcuuuguguugcuuuguugggguucaucaugugggccugccaaaaaggcaacauuaggugcaacauuugcauuuaa

SEQ ID NO: 41774 - RNA, 1701 nt, Artificial Sequence
  hemagglutinin__InfluenzaA__AHL90110
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacaggaaaucuaauugcuccuagggguuacuucaaaauacaaagugggaaaagcucaguaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaguucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41775 - RNA, 1698 nt, Artificial Sequence
  hemagglutinin__InfluenzaA__AHL90122
augaaagcaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaguuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuaugucucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagagguuuaggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaacucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguccuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 41776 - RNA, 1698 nt, Artificial Sequence
  hemagglutinin__InfluenzaA__AHL90133
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggauggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggauuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 41777 - RNA, 1698 nt, Artificial Sequence
  hemagglutinin__InfluenzaA__AHL90145
augaaagcaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuaugucucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagagguuuaggaucagguaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguccuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 41778 - RNA, 1698 nt, Artificial Sequence
  hemagglutinin__InfluenzaA__AHL90157
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucagugucuucguuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuaugucucuguagugucuucacauuauagcagaaaauucaccccagaaauagccaagagacccaaaguaagagaucaagaaggaagaaucaacuacuacuggacucugcuugaacccggggauacuauaauauuugaggcaaauggaaaucuaauagcgccaagauaugcuuucgcacugaguagaggcuuuggaucaggaaucaucaacucaaaugcuccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaauccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuagcgaucuacucaacaaucgccaguucucugguucuuuuggucucccugggggcaaucagcuucuggauguguuccaaugggucuuugcaguguagaauaugcaucuaa

SEQ ID NO: 41779 - RNA, 1698 nt, Artificial Sequence; identical to SEQ ID NO: 41777
  hemagglutinin__InfluenzaA__AHL90169

SEQ ID NO: 41780 - RNA, 1698 nt, Artificial Sequence
  hemagglutinin__InfluenzaA__AHL90181
augaaaguaaaacuacugguccuguuaugcacauuugcagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauugcugauuuccaaggagucaugguccuacauuguagaaaaaccaaauccuaagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuaugucucuguagugucuucacauuauagcagaaaauucaccccagaaauagccaaaagacccaaaguaagagaucaagaaggaagaaucaauuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucagaagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaguauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 41781 - RNA, 1698 nt, Artificial Sequence; identical to SEQ ID NO: 33674
  hemagglutinin__InfluenzaA__AHL90217

SEQ ID NO: 41782 - RNA, 1698 nt, Artificial Sequence; identical to SEQ ID NO: 33674
  hemagglutinin__InfluenzaA__AHL90229

SEQ ID NO: 41783 - RNA, 1698 nt, Artificial Sequence
  hemagglutinin__InfluenzaA__AHL90241
augaaaguaaaacuacugguccuguuaugcacauuuacagcuacauaugcagacacaauauguauaggcuaccaugcuaacaacucaaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauucccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuaugucucuguagugucuucacauuauagcagaaaauucaccccagaaauagccaaaagacccaaaguaagagaucaagaaggaagaaucaauuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagccuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 41784 - RNA, 1698 nt, Artificial Sequence
  hemagglutinin__InfluenzaA__AHL90253
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaaggaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaaguaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 41785 - RNA, 1698 nt, Artificial Sequence
  hemagglutinin__InfluenzaA__AHL90265
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagccacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucagaagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcugaacuguugguucuacuggaaaaugaaaggacuuuggauuuccaugacuccaaugugaagaaucuguaugagaaaguaaaaagccaguuaaagaacaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 41786 - RNA, 1698 nt, Artificial Sequence
  hemagglutinin__InfluenzaA__AHL90277
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaguugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 41787 - RNA, 1698 nt, Artificial Sequence
  hemagglutinin__InfluenzaA__AHL90289
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguuugaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuaugucucuguagugucuucacauuauagcagaaaauucaccccagaaauagccaaaagacccaaaguaagagaucaagaaggaagaaucaauuacuacuggacucugcuugagcccagggauacaauaauauuugaggcaaauggaaaucuaauagcgccaagauaugcuuucgcacugaguagaggcuuuggaucaggaaucaucaacucaaaugcaccaauggauaaaugugaugcaaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 41788 - RNA, 1698 nt, Artificial Sequence; identical to SEQ ID NO: 41787
  hemagglutinin__InfluenzaA__AHL90301

SEQ ID NO: 41789 - RNA, 1698 nt, Artificial Sequence
  hemagglutinin__InfluenzaA__AHL90325
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaagaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcaccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaaggaggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaaugggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 41790 - RNA, 1698 nt, Artificial Sequence; identical to SEQ ID NO: 41789
  hemagglutinin__InfluenzaA__AHL90337

SEQ ID NO: 41791 - RNA, 1698 nt, Artificial Sequence
  hemagglutinin__InfluenzaA__AHL90349
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuaugucucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucuggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuag

SEQ ID NO: 41792 - RNA, 1698 nt, Artificial Sequence
  hemagglutinin__InfluenzaA__AHL90361
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcaccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaaggaggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 41793 - RNA, 1698 nt, Artificial Sequence
  hemagglutinin__InfluenzaA__AHL90373
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaguugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggauggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 41794 - RNA, 1701 nt, Artificial Sequence
  hemagglutinin__InfluenzaA__AHL90385
augaagacuaucauugcuuugagcuacauucaaugucugguuuucgcucaaaaauuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaauugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacucaaaauucaaauacccagcauugaacgugacuaugccaaacaaugaaaauuuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcugguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggagaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugauucagaaaugaacaaacuguuugaaaaaacaaagaagcaacugagggaaaaugcugaggauaugggcaaugguuguuucaaaaucuaccacaaaugugacaaugccugcauaggaucaaucagaaauggaacuuaugaccacgaugucuacagagaugaagcauuaaacaaccgguuccagaucaagggcguugagcugaagucaggauacaaagauuggauccuauggauuuccuuugccauaucauguuuuuugcuuugcauugcuuuguugggguucaucaugugggccugccaaaaaggcaacauuaggugcaacauuugcauuuga

SEQ ID NO: 41795 - RNA, 1701 nt, Artificial Sequence
  hemagglutinin__InfluenzaA__AHL90397
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccagauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaguucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41796 - RNA, 1701 nt, Artificial Sequence; identical to SEQ ID NO: 33040
  hemagglutinin__InfluenzaA__AHL90410

SEQ ID NO: 41797 - RNA, 1701 nt, Artificial Sequence
  hemagglutinin__InfluenzaA__AHL90422
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaacaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacucaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugagcaaacuguuugaaaaaacaaagaagcaacugagggaaaaugcugaggauaugggcaaugguuguuucaaaauauaccacaaaugugacaauaccugcauaggaucaaucagaaauggaacuuaugaccacaauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41798 - RNA, 1701 nt, Artificial Sequence
  hemagglutinin__InfluenzaA__AHL90434
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaucacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41799 - RNA, 1701 nt, Artificial Sequence; identical to SEQ ID NO: 33043
  hemagglutinin__InfluenzaA__AHL90446

SEQ ID NO: 41800 - RNA, 1701 nt, Artificial Sequence
  hemagglutinin__InfluenzaA__AHL90458
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcgcacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuaguagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41801 - RNA, 1701 nt, Artificial Sequence
  hemagglutinin__InfluenzaA__AHL90470
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugaacugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaaacugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41802 - RNA, 1701 nt, Artificial Sequence; identical to SEQ ID NO: 33043
  hemagglutinin__InfluenzaA__AHL90482

SEQ ID NO: 41803 - RNA, 1701 nt, Artificial Sequence; identical to SEQ ID NO: 33061
  hemagglutinin__InfluenzaA__AHL90494

SEQ ID NO: 41804 - RNA, 1701 nt, Artificial Sequence; identical to SEQ ID NO: 33061
  hemagglutinin__InfluenzaA__AHL90506

SEQ ID NO: 41805 - RNA, 1701 nt, Artificial Sequence
  hemagglutinin__InfluenzaA__AHL90518
augaagacuaucauugcuuugagcuacauucuaugucugguuuucgcucaaaaacuuccuggaaaugacaacagcacggcaacgcugugccuugggcaccaugcaguaccaaacggaacaauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaaaaaugaaagcuucaauuggacuggagucacucaaaacggaacaagcucugcuugcauaaggagaucuaauaacaguuucuuuaguagauugaauugguugacccacuuaaaauucaaauacccagcauugaaugugacuaugccaaacaaagaaaaauuugacaaauuguacauuugggggguucaccacccggguacggacaaugaccaaaucuuccuguaugcucaagcaucaggaagaaucacagucucuaccaaaagaagucaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaacaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugauucagaaaugaacaaacuguuugaaaaaacaaagaagcaacugagggaaaaugcugaggauaugggcaaugguuguuucaaaaucuaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacaucugcauuuga

SEQ ID NO: 41806 - RNA, 1701 nt, Artificial Sequence
  hemagglutinin__InfluenzaA__AHL90530
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccauucaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaauggaaagcugaauagguugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaaaucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41807 - RNA, 1701 nt, Artificial Sequence
  hemagglutinin__InfluenzaA__AHL90542
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagagggcaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41808 - RNA, 1701 nt, Artificial Sequence
  hemagglutinin__InfluenzaA__AHL90554
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaagauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41809 - RNA, 1701 nt, Artificial Sequence
  hemagglutinin__InfluenzaA__AHL90566
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccguuuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41810 - RNA, 1701 nt, Artificial Sequence
  hemagglutinin__InfluenzaA__AHL90578
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggagcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggaacuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41811 - RNA, 1701 nt, Artificial Sequence; identical to SEQ ID NO: 33061
  hemagglutinin__InfluenzaA__AHL90590

SEQ ID NO: 41812 - RNA, 1701 nt, Artificial Sequence; identical to SEQ ID NO: 33027
  hemagglutinin__InfluenzaA__AHL90602

SEQ ID NO: 41813 - RNA, 1701 nt, Artificial Sequence; identical to SEQ ID NO: 33712
  hemagglutinin__InfluenzaA__AHL90614

SEQ ID NO: 41814 - RNA, 1701 nt, Artificial Sequence
  hemagglutinin__InfluenzaA__AHL90638
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaaguaggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41815 - RNA, 1701 nt, Artificial Sequence
  hemagglutinin__InfluenzaA__AHL90650
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaccuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauagggucaaucagaaauggaacuuaugaccacgauguauacagagaugaagcauuaaacaaccgguuccagaucaaaggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41816 - RNA, 1701 nt, Artificial Sequence
  hemagglutinin__InfluenzaA__AHL90662
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauaugucaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41817 - RNA, 1701 nt, Artificial Sequence
  hemagglutinin__InfluenzaA__AHL90674
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggaaggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugucugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41818 - RNA, 1701 nt, Artificial Sequence
  hemagglutinin__InfluenzaA__AHL90686
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugccauggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41819 - RNA, 1701 nt, Artificial Sequence; identical to SEQ ID NO: 33027
  hemagglutinin__InfluenzaA__AHL90698

SEQ ID NO: 41820 - RNA, 1701 nt, Artificial Sequence; identical to SEQ ID NO: 33027
  hemagglutinin__InfluenzaA__AHL90710

SEQ ID NO: 41821 - RNA, 1698 nt, Artificial Sequence
  hemagglutinin__InfluenzaA__AHL90722
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacugugucuauuaaaaggaauagccccacuacaauuggguaacugcagcguugccggguggaucuuaggaaauccagaaugcgaguuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagaaguuuuuacagaaauuugcuauggcugacggggaagaaugguuuguacccaaaccugagcaaguccuaugcaaacaacaaagaaaaagaaguccuuguacuaugggguguucaucacccgccagacauaggugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacuggacuaaggaacaucccauccauucaauccagagguuuguuuggagccauugccgguuucauugaagggggguggacuggaaugguagaugguugguaugguuaucaucaucagaaugagcaagggucuggcuaugcugcagaucaaaaaagcacacaaaaugccauuaauggaauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugauuccaaugugaagaaucuguaugagaaaguaaaaagccaguuaaagaauaaugcuaaagaaauaggaaauggguguuuugaauucuaucacaaguguaacgaugagugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucaguuucuggauguguuccaaugggucuuugcaguguagaauaugcaucuaa

SEQ ID NO: 41822 - RNA, 1698 nt, Artificial Sequence
  hemagglutinin__InfluenzaA__AHL90746
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaagagucaugguccuacauuguagaaaaaccaaauccugagaauggaacauguuacccagggcauuucgcugacuaugaggaacugagggagcaauugaguucaguaucuucauuuaagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaguugaccaaaagacccucuaccguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggguaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 41823 - RNA, 1698 nt, Artificial Sequence
  hemagglutinin__InfluenzaA__AHL90758
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaaaugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 41824 - RNA, 1698 nt, Artificial Sequence
  hemagglutinin__InfluenzaA__AHL90770
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagauagcucauggcccaaccacaccguaaccggagugucagcaucauguucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaagcauaaaugaccaaaagacccucuaucauacagaaaaugcuuauguuucuguagugucuucacaucauagcaggaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacauccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucugacgaucuacucaacagucgccaguucucugguucuuuuggucucccugggggcaaucagcuucuggauguguuccaaugggucuuugcaguguagaauaugcaucuaa

SEQ ID NO: 41825 - RNA, 1698 nt, Artificial Sequence; identical to SEQ ID NO: 36893
  hemagglutinin__InfluenzaA__AHL90782

SEQ ID NO: 41826 - RNA, 1698 nt, Artificial Sequence
  hemagglutinin__InfluenzaA__AHL90794
augaaaguaaaacuauugguccuguuaugcacauuuacagcuacauaugcggacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccacaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaauacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcaccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuauucaacagucgccaguucucugguucuuuuggucucccugggggcaaucagcuucuggauguguuccaaugggucuuugcaguguagaauaugcaucuaa

SEQ ID NO: 41827 - RNA, 1698 nt, Artificial Sequence
  hemagglutinin__InfluenzaA__AHL90806
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaaaugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuugaucucccugggggcaaucagcuucuggauguguuccaaugggucuuugcaguguagaauaugcaucuaa

SEQ ID NO: 41828 - RNA, 1698 nt, Artificial Sequence; identical to SEQ ID NO: 37156
  hemagglutinin__InfluenzaA__AHL90818

SEQ ID NO: 41829 - RNA, 1698 nt, Artificial Sequence
  hemagglutinin__InfluenzaA__AHL90830
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacugugucuauuaaaaggaauagccccacuacaauuggguaacugcagcguugccggguggaucuuaggaaauccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagaaguuuuuacagaaauuugcuauggcugacggggaagaaugguuuguacccaaaccugagcaaguccuaugcaaacaacaaagaaaaagaaguccuuguacuaugggguguucaucacccgccagacauaggugaccaaaagacccucuaucauacagaaaaugcuuauguuucuguagugucuucacauuauagcagaaaauucaccccagaaauagccaaaagacccaaaguaagagaucaggaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacuggacuaaggaacaucccauccauucaauccagagguuuguuuggagccauugccgguuucauugaagggggguggacuggaaugguagaugguugguaugguuaucaucaucagaaugagcaagggucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugauuccaaugugaagaaucuguaugagaaaguaaaaagccaguuaaagaauaaugcuaaagaaauaggaaauggguguuuugaauucuaucacaaguguaacgaugagugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucaguuucuggauguguuccaaugggucuuugcaguguagaauaugcaucuaa

SEQ ID NO: 41830 - RNA, 1698 nt, Artificial Sequence; identical to SEQ ID NO: 41823
  hemagglutinin__InfluenzaA__AHL90842

SEQ ID NO: 41831 - RNA, 1698 nt, Artificial Sequence
  hemagglutinin__InfluenzaA__AHL90854
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaagagucaugguccuacauuguagaaaaaccaaauccugagaauggaacauguuacccagggcauuucgcugauuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaguugaccaaaagacccucuaccguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggguaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 41832 - RNA, 1698 nt, Artificial Sequence
  hemagglutinin__InfluenzaA__AHL90866
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaaaugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauuuuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 41833 - RNA, 1698 nt, Artificial Sequence
  hemagglutinin__InfluenzaA__AHL90878
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaagagucaugguccuacauuguagaaaaaccaaauccugagaauggaacauguuacccagggcauuucgcugauuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaguugaccaaaagacccucuaccguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggguaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggaaaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 41834 - RNA, 1698 nt, Artificial Sequence; identical to SEQ ID NO: 41829
  hemagglutinin__InfluenzaA__AHL90890

SEQ ID NO: 41835 - RNA, 1698 nt, Artificial Sequence; identical to SEQ ID NO: 36035
  hemagglutinin__InfluenzaA__AHL90902

SEQ ID NO: 41836 - RNA, 1698 nt, Artificial Sequence
  hemagglutinin__InfluenzaA__AHL90914
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaaaugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacucuaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccgaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 41837 - RNA, 1698 nt, Artificial Sequence; identical to SEQ ID NO: 36035
  hemagglutinin__InfluenzaA__AHL90938

SEQ ID NO: 41838 - RNA, 1698 nt, Artificial Sequence; identical to SEQ ID NO: 36035
  hemagglutinin__InfluenzaA__AHL90950

SEQ ID NO: 41839 - RNA, 1698 nt, Artificial Sequence; identical to SEQ ID NO: 36035
  hemagglutinin__InfluenzaA__AHL90962

SEQ ID NO: 41840 - RNA, 1698 nt, Artificial Sequence
  hemagglutinin__InfluenzaA__AHL90974
augaaaguaaaacuacuaguccuguuaugcacauuuacagcuacauaugcagacacaauauguauaggcuaccaugcuaacaacucgaccgacacuguugacacaguacuugaaaagaauguaacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaagcauaagugaucaaaagacccucuaucauacagaaaaugcuuauguuucuguagugucuucacauuauagcagaaaauucaccccagaaguagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaauaugucaggagugcaaaauuaaggaugguuacaggacuaaggaacaucccauccauucaauccagagguuuguuuggagccauugccgguuucauugaagggggguggacuggaaugguagacgguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaggccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 41841 - RNA, 1698 nt, Artificial Sequence
  hemagglutinin__InfluenzaA__AHL90986
augaaaguaaaacuacugguccuguuaugcacauuuacagcuacauaugcagacacaauauguauaggcuaccaugcuaacaacucgaccgacacuguugacacaguacuugaaaagaaugugacagugacacacucuguuaaccugcuugagaacagucacaauggaaaacuauguuuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggugaagaaugguuuguacccaaacuugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguaaaggcuuuggaucaggaaucaucaacucaaaugcaccaauggauaaaugugaugcgaagugccaaacaccucggggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaaccuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 41842 - RNA, 1698 nt, Artificial Sequence
  hemagglutinin__InfluenzaA__AHL91010
augaaaguaaaacuacugguccugcuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggaacaauugaguucaguaucuucauuugagagguucgaaauauuccccaaagauagcucauggcccaaccacaccguaaccggagugucagcaucauguucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaagcauaaaugaccaaaagacccucuaucauacagaaaaugcuuauguuucuguagugucuucacauuauagcaggaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaaugggacuuaugacuauccaaaauauuccgaagaaucaaaguuaaacagggagaaaauugauggagugaaauuggaaucaaugggagucuaucagauucugacgaucuacucaacagucgccaguucucugguucuuuuggucucccugggggcaaucagcuucuggauguguuccaaugggucuuugcaguguagaauaugcaucuaa

SEQ ID NO: 41843 - RNA, 1698 nt, Artificial Sequence
  hemagglutinin__InfluenzaA__AHL91022
augaaaguaaaacuacugguccugcuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggaacaauugaguucaguaucuucauuugagagguucgaaauauuccccaaagauagcucauggcccaaccacaccguaaccggagugucagcaucauguucccauaauggggaaaacaguuuuuacagaaauuugcuauggcugacggggaagaaugguuuguacccaaaccugagcaaguccuaugcaaacaacaaagaaaaagaaguccuuguacuaugggguguucaucacccgccaagcauaaaugaccaaaagacccucuaucauacagaaaaugcuuauguuucuguagugucuucacauuauagcaggaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaagguaaaaagccaguuaaagaauaaugcuaaagaaauaggaaauggguguuuugaauucuaucacaaguguaacgaugaaugcauggagaguguaaagaaugggacuuaugacuauccaaaauauuccgaagaaucaaaguuaaacagggagaaaauugauggagugaaauuggaaucaaugggagucuaucagauucugacgaucuacucaacagucgccaguucucugguucuuuuggucucccugggggcaaucagcuucuggauguguuccaaugggucuuugcaguguagaauaugcaucuaa

SEQ ID NO: 41844 - RNA, 1701 nt, Artificial Sequence
  hemagglutinin__InfluenzaA__AHL91034
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucaaugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauuaaacguaacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuuuaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41845 - RNA, 1701 nt, Artificial Sequence
  hemagglutinin__InfluenzaA__AHL91046
augaagacuaucauugcuuugagcuacauucuaugucugguuuucgcucaaaaacuuccuggaaaugacaacagcacggcaacgcugugccuugggcaccaugcaguaccaaacggaacgauagugaaaacaauaacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcauaaggagaucuaauaacaguuucuuuaguagauuaaauugguugacccacuuaagauucaaguacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacaccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucggaaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41846 - RNA, 1701 nt, Artificial Sequence
  hemagglutinin__InfluenzaA__AHL91058
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauuaaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuuuaaaauacgaagugggaaaagcucaauaaugagaucagaugcgcccauuggcaaaugcaauucugaaugcaucacuccaaauggaagcauucccaaugacaaaccauuccaaaauguaaacagaaucacauacggggccugucccagauauguuaagcaaaacacucugaaauuggcaacagggaugcgaaauguaccagagaaacaaacuagaggcauauuuggugcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugccauggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaggauuggauccuauggauuuccuuugccauaucauguuuuuugcuuuguguugcuuuguugggguucaucaugugggccugccaaaaaggcaacauuaggugcaacauuugcauuuga

SEQ ID NO: 41847 - RNA, 1701 nt, Artificial Sequence
  hemagglutinin__InfluenzaA__AHL91070
augaagacuaucauugcuuugagcuacauucuaugucugguuuucgcucaaaaacuuccuggaaaugacaacagcauggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcaugaggagaucuaauaacaguuucuuuaguagauugaauugguugacccacuuaaaauucaaauacccagcauuaaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauaugucaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaauggaaagcugaauagacugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41848 - RNA, 1701 nt, Artificial Sequence
  hemagglutinin__InfluenzaA__AHL91082
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccccaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaaugugaacaggaucacauacggggccugucccauauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41849 - RNA, 1701 nt, Artificial Sequence; identical to SEQ ID NO: 37208
  hemagglutinin__InfluenzaA__AHL91094

SEQ ID NO: 41850 - RNA, 1701 nt, Artificial Sequence
  hemagglutinin__InfluenzaA__AHL91106
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaaaaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauuaaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaagauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41851 - RNA, 1701 nt, Artificial Sequence
  hemagglutinin__InfluenzaA__AHL91118
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacgggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguaaauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucagacaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguuacccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41852 - RNA, 1701 nt, Artificial Sequence
  hemagglutinin__InfluenzaA__AHL91130
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauuaaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41853 - RNA, 1701 nt, Artificial Sequence
  hemagglutinin__InfluenzaA__AHL91142
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucggaaaaaccaacgagaaauuccaucagauugaaaaggaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaaaaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41854 - RNA, 1701 nt, Artificial Sequence; identical to SEQ ID NO: 41853
  hemagglutinin__InfluenzaA__AHL91154

SEQ ID NO: 41855 - RNA, 1701 nt, Artificial Sequence; identical to SEQ ID NO: 31139
  hemagglutinin__InfluenzaA__AHL91166

SEQ ID NO: 41856 - RNA, 1701 nt, Artificial Sequence; identical to SEQ ID NO: 40971
  hemagglutinin__InfluenzaA__AHL94984

SEQ ID NO: 41857 - RNA, 1701 nt, Artificial Sequence; identical to SEQ ID NO: 40971
  hemagglutinin__InfluenzaA__AHL94996

SEQ ID NO: 41858 - RNA, 1701 nt, Artificial Sequence
  hemagglutinin__InfluenzaA__AHL95008
augaagaccaucauugcuuugagcuacauucuaugucuaguuuuugcucaagaacuuccuggaaaugacgacagcacggcaacgcugugccuugggcaccaugcagugccaaacggaacgauagugaaaacaaucacgaaugaccaaauugaaguuacuaaugcuacugaacugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugauugggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41859 - RNA, 1701 nt, Artificial Sequence; identical to SEQ ID NO: 41002
  hemagglutinin__InfluenzaA__AHL95020

SEQ ID NO: 41860 - RNA, 1701 nt, Artificial Sequence; identical to SEQ ID NO: 40981
  hemagglutinin__InfluenzaA__AHL95032

SEQ ID NO: 41861 - RNA, 1701 nt, Artificial Sequence; identical to SEQ ID NO: 40984
  hemagglutinin__InfluenzaA__AHL95044

SEQ ID NO: 41862 - RNA, 1701 nt, Artificial Sequence; identical to SEQ ID NO: 40371
  hemagglutinin__InfluenzaA__AHL95056

SEQ ID NO: 41863 - RNA, 1701 nt, Artificial Sequence
  hemagglutinin__InfluenzaA__AHL95068
augaagacuaucauugcuuugagcuacauucuaugucuaguuuucgcucaaaaacuuccuggaaaugacaauagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaguacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugagaaagaauucucagaaguagaagggagaauucaggaccuugagaaauauguugaggacacaaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41864 - RNA, 1701 nt, Artificial Sequence; identical to SEQ ID NO: 41049
  hemagglutinin__InfluenzaA__AHL95080

SEQ ID NO: 41865 - RNA, 1701 nt, Artificial Sequence
  hemagglutinin__InfluenzaA__AHL95092
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucaaauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41866 - RNA, 1701 nt, Artificial Sequence
  hemagglutinin__InfluenzaA__AHL95104
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcaugaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaucaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41867 - RNA, 1701 nt, Artificial Sequence
  hemagglutinin__InfluenzaA__AHL95116
augaagaccaucauugcuuugagcuacauucuaugucuaguuuucgcucaagaacuuccuggaaaugacgacagcacggcaacgcugugccuugggcacuaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacagacaaggaccaaaucuuccuguaugcuaaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguguacagagaugaagcauuaaauaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41868 - RNA, 1701 nt, Artificial Sequence
  hemagglutinin__InfluenzaA__AHL95128
augaagaccaucauugcuuugagcuacauucuaugucuaguuuucgcucaagaacuuccuggaaaugacgacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucagggagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggaaggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaaugggacuuaugaucacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41869 - RNA, 1701 nt, Artificial Sequence; identical to SEQ ID NO: 40988
  hemagglutinin__InfluenzaA__AHL95140

SEQ ID NO: 41870 - RNA, 1701 nt, Artificial Sequence; identical to SEQ ID NO: 40372
  hemagglutinin__InfluenzaA__AHL95152

SEQ ID NO: 41871 - RNA, 1701 nt, Artificial Sequence; identical to SEQ ID NO: 40592
  hemagglutinin__InfluenzaA__AHL95164

SEQ ID NO: 41872 - RNA, 1701 nt, Artificial Sequence
  hemagglutinin__InfluenzaA__AHL95176
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggagaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41873 - RNA, 1701 nt, Artificial Sequence; identical to SEQ ID NO: 40984
  hemagglutinin__InfluenzaA__AHL95188

SEQ ID NO: 41874 - RNA, 1701 nt, Artificial Sequence; identical to SEQ ID NO: 40997
  hemagglutinin__InfluenzaA__AHL95200

SEQ ID NO: 41875 - RNA, 1701 nt, Artificial Sequence; identical to SEQ ID NO: 40984
  hemagglutinin__InfluenzaA__AHL95212

SEQ ID NO: 41876 - RNA, 1701 nt, Artificial Sequence; identical to SEQ ID NO: 40371
  hemagglutinin__InfluenzaA__AHL95224

SEQ ID NO: 41877 - RNA, 1701 nt, Artificial Sequence; identical to SEQ ID NO: 41050
  hemagglutinin__InfluenzaA__AHL95236

SEQ ID NO: 41878 - RNA, 1701 nt, Artificial Sequence
  hemagglutinin__InfluenzaA__AHL95248
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccgggcacggacaaggaccaaaucuuccuguaugcucaaucaucaggaagaaucacaguaucuaccaaaagaagccaacaagcuguaaucccgaauaucgggucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41879 - RNA, 1701 nt, Artificial Sequence
  hemagglutinin__InfluenzaA__AHL95260
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaagucacuaaugcuacugagcugguucagaauuccucaauaagugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggggucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaaccagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaaugcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41880 - RNA, 1701 nt, Artificial Sequence
  hemagglutinin__InfluenzaA__AHL95272
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugcgauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41881 - RNA, 1701 nt, Artificial Sequence; identical to SEQ ID NO: 40981
  hemagglutinin__InfluenzaA__AHL95284

SEQ ID NO: 41882 - RNA, 1701 nt, Artificial Sequence
  hemagglutinin__InfluenzaA__AHL95296
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaaaauacagcaagaaguucaagccggaaauagcaauaagacccaaagugagggaucaagaagggagaaugaacuauuacuggacacuaauagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaagacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 41883 - RNA, 1701 nt, Artificial Sequence
  hemagglutinin__InfluenzaA__AHL95307
augaagaccaucauugcuuugagcuacauucuaugucuaguuuuugcucaagaacuuccuggaaaugacgacagcacggcaacgcugugccuugggcaccaugcagugccaaacggaacgauagugaaaacaaucacgaaugaccaaauugaaguuacuaaugcuacugaacugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaauuuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41884 - RNA, 1701 nt, Artificial Sequence; identical to SEQ ID NO: 40371
  hemagglutinin__InfluenzaA__AHL95319

SEQ ID NO: 41885 - RNA, 1701 nt, Artificial Sequence
  hemagglutinin__InfluenzaA__AHL95331
augaagacuaucauugcuuugagcuacauucuaugucugguuuucgcucaaaaacuuccuggagaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugagcaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaaaucugaauguaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41886 - RNA, 1701 nt, Artificial Sequence
  hemagglutinin__InfluenzaA__AHL95343
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugagcaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaaaucugaauguaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaggggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41887 - RNA, 1701 nt, Artificial Sequence; identical to SEQ ID NO: 40371
  hemagglutinin__InfluenzaA__AHL95432

SEQ ID NO: 41888 - RNA, 1701 nt, Artificial Sequence; identical to SEQ ID NO: 40551
  hemagglutinin__InfluenzaA__AHL95444

SEQ ID NO: 41889 - RNA, 1701 nt, Artificial Sequence; identical to SEQ ID NO: 40371
  hemagglutinin__InfluenzaA__AHL95457

SEQ ID NO: 41890 - RNA, 1701 nt, Artificial Sequence
  hemagglutinin__InfluenzaA__AHL95470
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugaacugguucagaguuccucaacaggugaaauaugcaacaguccucaucagauucuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucaagcaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaagaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaaugugaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaucacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41891 - RNA, 1701 nt, Artificial Sequence; identical to SEQ ID NO: 40981
  hemagglutinin__InfluenzaA__AHL95482

SEQ ID NO: 41892 - RNA, 1701 nt, Artificial Sequence; identical to SEQ ID NO: 40981
  hemagglutinin__InfluenzaA__AHL95494

SEQ ID NO: 41893 - RNA, 1701 nt, Artificial Sequence
  hemagglutinin__InfluenzaA__AHL95506
augaagaccaucauugcuuugagcuacauucuaugucugguuuucgcucaaaaacuuccuggaaaugacaauagcacggcaacgcugugccuugggcaccaugcaguaccaaacggaacgauagugagaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauccccaaugacaaaccauuccaaaauguaaacaggaucacauacggggccugucccagauauguuaagcaaagcacucugaaauuggcaacaggaaugcgaaauguaccagagaaacaaaccagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41894 - RNA, 1701 nt, Artificial Sequence
  hemagglutinin__InfluenzaA__AHL95518
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaaugucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41895 - RNA, 1701 nt, Artificial Sequence
  hemagglutinin__InfluenzaA__AHL95530
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuuuaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41896 - RNA, 1701 nt, Artificial Sequence
  hemagglutinin__InfluenzaA__AHL95542
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaagaaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41897 - RNA, 1701 nt, Artificial Sequence
  hemagglutinin__InfluenzaA__AHL95554
augaagacuaucauugcuuugagcuacauucuaugucugguuuucgcucaaaaacuuccuggaaaugacaauagcauggcaacgcugugccuugggcaccaugcaguaccaaacggaacgauagugaaaacaaucacgaaugaccgaauugaaguuacuaaugcuacugagcugguucagaauucuucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaaggaauauuccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggaggggaugguggaugguugguacgguuucaggcaucaaaauucugagggaagaggacaagcagcagaucucaaaagcacccaagcagcaaucgaucaaaucaaugggaagcuaaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41898 - RNA, 1701 nt, Artificial Sequence
  hemagglutinin__InfluenzaA__AHL95566
augaagacuaucauugcuuugagcuacauucuaugucuaguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugagcaauuugacaaauuguacauuugggggguucaccacccggguacggacaaggaccaaaucuuccuguaugcucgaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaaaucugaauguaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaguuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41899 - RNA, 1701 nt, Artificial Sequence
  hemagglutinin__InfluenzaA__AHL95578
augaagacuaucauugcuuugagcuacauucuaugucugguuuucgcucaaaaacuuccuggaaaugacgauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccagaauguaaacagaaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41900 - RNA, 1701 nt, Artificial Sequence
  hemagglutinin__InfluenzaA__AHL95590
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucuucuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaaggaauauuccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggaggggaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41901 - RNA, 1701 nt, Artificial Sequence; identical to SEQ ID NO: 40984
  hemagglutinin__InfluenzaA__AHL95602

SEQ ID NO: 41902 - RNA, 1701 nt, Artificial Sequence; identical to SEQ ID NO: 40984
  hemagglutinin__InfluenzaA__AHL95614

SEQ ID NO: 41903 - RNA, 1701 nt, Artificial Sequence
  hemagglutinin__InfluenzaA__AHL95626
augaagacuaucauugcuuugagcuacguucuaugucugguuuucgcucaaaaacuuccuggaaaugacaauagcacggcaacgcugugccuugggcaccaugcaguaccaaacggaacgauagugaaaacaaucacgaaugaccgaauugaagucacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggggucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaauuccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaaccagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41904 - RNA, 1701 nt, Artificial Sequence; identical to SEQ ID NO: 40372
  hemagglutinin__InfluenzaA__AHL95638

SEQ ID NO: 41905 - RNA, 1701 nt, Artificial Sequence
  hemagglutinin__InfluenzaA__AHL95650
augaagacuaucauugcuuugagcuacauucuaugucugguuuucgcucaaaaacuuccuggaaaugacaauagcacggcaacgcugugucuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaacugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41906 - RNA, 1701 nt, Artificial Sequence
  hemagglutinin__InfluenzaA__AHL95662
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguuacccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41907 - RNA, 1701 nt, Artificial Sequence
  hemagglutinin__InfluenzaA__AHL95686
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugagcaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaaaucugaauguaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagagaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41908 - RNA, 1701 nt, Artificial Sequence; identical to SEQ ID NO: 40522
  hemagglutinin__InfluenzaA__AHL95698

SEQ ID NO: 41909 - RNA, 1701 nt, Artificial Sequence
  hemagglutinin__InfluenzaA__AHL95710
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggugcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41910 - RNA, 1701 nt, Artificial Sequence; identical to SEQ ID NO: 41886
  hemagglutinin__InfluenzaA__AHL95722

SEQ ID NO: 41911 - RNA, 1701 nt, Artificial Sequence
  hemagglutinin__InfluenzaA__AHL95734
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggcuugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaguugagcuuaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41912 - RNA, 1701 nt, Artificial Sequence
  hemagglutinin__InfluenzaA__AHL95746
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaaggaauauuccuagcagaauaagcaucuauuggacaauaguaaaaccgggagacauacuuuugauuaacagcacagggaaccuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggaggggaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41913 - RNA, 1701 nt, Artificial Sequence
  hemagglutinin__InfluenzaA__AHL95758
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaguacccagcauugaacgugacuaugccaaacaaugaacaauuugacaaauuguacauuugggggguucaccacccggguacggacaaggaccaaaucuuccuguaugcucaaucaucaggaagaaucacaguauccaccaaaagaagccaacaagcuguaaucccgaauaucggaucuagacccagaauaaggaauaucccuagcagaauaagcaucuauuggacaauaguaaaaccgggagacauacuuuugauuaacagcacaggaaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugagaaagaauucucagaaguagaagggagaauucaggaccuugagaaauauguugaggacacaaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggaucuuauggauuuccuuugccauaucauguuuuuugcuuuguguugcuuuguugggguucaucaugugggccugccaaaagggcaacauuaggugcaacauuugcauuuga

SEQ ID NO: 41914 - RNA, 1701 nt, Artificial Sequence; identical to SEQ ID NO: 40984
  hemagglutinin__InfluenzaA__AHL95770

SEQ ID NO: 41915 - RNA, 1701 nt, Artificial Sequence
  hemagglutinin__InfluenzaA__AHL95782
augaagacuaucauugcuuugagcuacauucuaugucugguuuucgcucaaaaacuuccuggaaaugacaauagcacggcgacgcugugccuugggcaccaugcaguaccaaacggaacgauagugaaaacaaucacgaaugaccgaauugaaguuacuaaugcuacugagcugguucagaauuccucaauaggugaaauaugcaacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucaccguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucuaaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaguucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41916 - RNA, 1701 nt, Artificial Sequence
  hemagglutinin__InfluenzaA__AHL95794
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaaacaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugagcaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaaaucugaauguaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41917 - RNA, 1701 nt, Artificial Sequence
  hemagglutinin__InfluenzaA__AHL95806
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaagucacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggggucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaaccagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguccaucaugugggccugccaaaaaggcaacauuaggugcaacauuugcauuuga

SEQ ID NO: 41918 - RNA, 1701 nt, Artificial Sequence; identical to SEQ ID NO: 40551
  hemagglutinin__InfluenzaA__AHL95818

SEQ ID NO: 41919 - RNA, 1701 nt, Artificial Sequence; identical to SEQ ID NO: 40371
  hemagglutinin__InfluenzaA__AHL95830

SEQ ID NO: 41920 - RNA, 1701 nt, Artificial Sequence
  hemagglutinin__InfluenzaA__AHL95842
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccucuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugagcaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaacaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaaaucugaauguaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuagaugcaacauuugcauuuga

SEQ ID NO: 41921 - RNA, 1701 nt, Artificial Sequence
  hemagglutinin__InfluenzaA__AHL95854
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucaaugugauggcuuccaaaauaagaaaugggaccuuuuuguugaacgaagcaaagccuacagcaacuguuacccguaugaugugccggauuaugccucccuuaggucacuaguugccucauccggcacacuggaguuuaacaaugaaagcuucaauuggacaggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcuaaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguucgaaaaaacaaagaagcaacugagggaaaaugcugaggauaugggcaaugguuguuucaaaauauaccacaaaugugacaaugccugcauaggaucaaucagaaauggaacuuaugaccacaauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41922 - RNA, 1701 nt, Artificial Sequence; identical to SEQ ID NO: 40984
  hemagglutinin__InfluenzaA__AHL95866

SEQ ID NO: 41923 - RNA, 1701 nt, Artificial Sequence
  hemagglutinin__InfluenzaA__AHL95878
augaaggcaauacuaguaauuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguauccccauugcauuuggguaaauguaacauugcuggcuggauccugggaaauccagagugugaaucacucuccacagcaagcucaugguccuacauuguggaaacaucugguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaggcuucuacaaaaauuuaauauggcuaguuaaaaaaggaaauucauacccaaagcucagcauauccuauauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauuugcaauggaaagaaaugcuggaucugguauuaucauuucagauacaccaguucacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccuucuauucaaucuagaggccuauuuggggccauugcuggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugauuacccaaaauacucagaggaagcaaaauuaaacagagaagaaauagaugggguaaagcuggaaucaacaaggauuuaccagauuuuggcgaucuauucaacugccgcuaguucauugguacugguagucucccugggggcaaucaguuuuuggaugugcucuaaugggucucuacaguguagaauauguauuuaa

SEQ ID NO: 41924 - RNA, 1701 nt, Artificial Sequence; identical to SEQ ID NO: 40372
  hemagglutinin__InfluenzaA__AHL95889

SEQ ID NO: 41925 - RNA, 1701 nt, Artificial Sequence; identical to SEQ ID NO: 40981
  hemagglutinin__InfluenzaA__AHL95901

SEQ ID NO: 41926 - RNA, 1701 nt, Artificial Sequence
  hemagglutinin__InfluenzaA__AHL95913
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaagucacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccucaggucacuaguugccucauccggcacacuggaguuuaacaaugaaagcuucaauugggcuggggucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaaccagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41927 - RNA, 1701 nt, Artificial Sequence
  hemagglutinin__InfluenzaA__AHL95937
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugagcaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaaaucugaauguaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaacagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41928 - RNA, 1701 nt, Artificial Sequence
  hemagglutinin__InfluenzaA__AHL95949
augaagacuaucauugcuuugagcuacauucuaugucuaguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacucaaacuucaaauacccagcauugaacaugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaacggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggugcaauagcggguuucauagaaaaugguugggagggaaugauggaugguugguacgguuucaggcaccaaaauucugagggaagaggacaagcagcagaucucaaaagcacucaagcagcaaucgaucaaaucaaugggaagcugaaucgauugaucgggaaaaccaacgagaaauuccaucagauugaaaaagaauuuucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41929 - RNA, 1701 nt, Artificial Sequence; identical to SEQ ID NO: 40984
  hemagglutinin__InfluenzaA__AHL95961

SEQ ID NO: 41930 - RNA, 1701 nt, Artificial Sequence
  hemagglutinin__InfluenzaA__AHL95973
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41931 - RNA, 1701 nt, Artificial Sequence
  hemagglutinin__InfluenzaA__AHL95985
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggugcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaccagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41932 - RNA, 1701 nt, Artificial Sequence
  hemagglutinin__InfluenzaA__AHL95997
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucuucuugcauaaggggaucuaagaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41933 - RNA, 1701 nt, Artificial Sequence
  hemagglutinin__InfluenzaA__AHL96021
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaagaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41934 - RNA, 1701 nt, Artificial Sequence; identical to SEQ ID NO: 40372
  hemagglutinin__InfluenzaA__AHL96033

SEQ ID NO: 41935 - RNA, 1701 nt, Artificial Sequence
  hemagglutinin__InfluenzaA__AHL96045
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaaggugugacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaauagagccgggagacaaaauaacauucgaagcaacuggaaaucuagugguaccgagauaugcguucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 41936 - RNA, 1701 nt, Artificial Sequence; identical to SEQ ID NO: 40981
  hemagglutinin__InfluenzaA__AHL96056

SEQ ID NO: 41937 - RNA, 1701 nt, Artificial Sequence; identical to SEQ ID NO: 41050
  hemagglutinin__InfluenzaA__AHL96068

SEQ ID NO: 41938 - RNA, 1701 nt, Artificial Sequence; identical to SEQ ID NO: 40984
  hemagglutinin__InfluenzaA__AHL96080

SEQ ID NO: 41939 - RNA, 1701 nt, Artificial Sequence
  hemagglutinin__InfluenzaA__AHL96092
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaagucacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuauugaacgaagcaaagccuacagcaacuguuacccuuaugaugugccggauuaugccucccuuaggucacuaguugccucauccggcacacuggaguuuaacaaugaaagcuucaauugggcuggggucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaaccagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41940 - RNA, 1701 nt, Artificial Sequence
  hemagglutinin__InfluenzaA__AHL96104
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagagacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaguugagcuuaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41941 - RNA, 1701 nt, Artificial Sequence
  hemagglutinin__InfluenzaA__AHL96116
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuauaccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41942 - RNA, 1701 nt, Artificial Sequence; identical to SEQ ID NO: 40371
  hemagglutinin__InfluenzaA__AHL96128

SEQ ID NO: 41943 - RNA, 1701 nt, Artificial Sequence; identical to SEQ ID NO: 40981
  hemagglutinin__InfluenzaA__AHL96152

SEQ ID NO: 41944 - RNA, 1701 nt, Artificial Sequence
  hemagglutinin__InfluenzaA__AHL96164
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaagucacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggggucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaaccagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaaaauuggauccuauggauuuccuuugccauaucauguuuuuugcuuuguguugcuuuguugggguucaucaugugggccugccaaaagggcaacauuaggugcaacauuugcauuuga

SEQ ID NO: 41945 - RNA, 1701 nt, Artificial Sequence; identical to SEQ ID NO: 40981
  hemagglutinin__InfluenzaA__AHL96176

SEQ ID NO: 41946 - RNA, 1701 nt, Artificial Sequence
  hemagglutinin__InfluenzaA__AHL96188
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugagcaauuugacaaauuguacauuugggggguccaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaaaucugaauguaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41947 - RNA, 1701 nt, Artificial Sequence
  hemagglutinin__InfluenzaA__AHL96200
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagguccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugagcaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaaaucugaauguaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41948 - RNA, 1701 nt, Artificial Sequence
  hemagglutinin__InfluenzaA__AHL96212
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaauggaaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaguugagcuuaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41949 - RNA, 1701 nt, Artificial Sequence; identical to SEQ ID NO: 40971
  hemagglutinin__InfluenzaA__AHL96224

SEQ ID NO: 41950 - RNA, 1701 nt, Artificial Sequence
  hemagglutinin__InfluenzaA__AHL96236
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaaugggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaagacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauagaaucaaucagaaauggaacuuaugaccacgauguauacagggaugaagcauuaaacaaccgguuccagaucaagggaguugagcugaagucaggguacaaaaauuggauccuauggauuuccuuugccauaucauguuuuuugcuuuguguugcuuuguugggguucaucaugugggccugccaaaagggcaacauuaggugcaacauuugcauuuga

SEQ ID NO: 41951 - RNA, 1701 nt, Artificial Sequence
  hemagglutinin__InfluenzaA__AHL96248
augaagacuaucauugcuuugggcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuauugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41952 - RNA, 1701 nt, Artificial Sequence; identical to SEQ ID NO: 40981
  hemagglutinin__InfluenzaA__AHL96260

SEQ ID NO: 41953 - RNA, 1701 nt, Artificial Sequence; identical to SEQ ID NO: 40371
  hemagglutinin__InfluenzaA__AHL96274

SEQ ID NO: 41954 - RNA, 1701 nt, Artificial Sequence; identical to SEQ ID NO: 40981
  hemagglutinin__InfluenzaA__AHL96304

SEQ ID NO: 41955 - RNA, 1701 nt, Artificial Sequence; identical to SEQ ID NO: 40592
  hemagglutinin__InfluenzaA__AHL96318

SEQ ID NO: 41956 - RNA, 1701 nt, Artificial Sequence; identical to SEQ ID NO: 40981
  hemagglutinin__InfluenzaA__AHL96330

SEQ ID NO: 41957 - RNA, 1701 nt, Artificial Sequence
  hemagglutinin__InfluenzaA__AHL96342
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggggaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaguacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugagaaagaauucucagaaguagaagggagaauucaggaccuugagaaauauguugaggacacaaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41958 - RNA, 1701 nt, Artificial Sequence
  hemagglutinin__InfluenzaA__AHL96354
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugagcaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaaaucugaauguaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucuaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41959 - RNA, 1701 nt, Artificial Sequence
  hemagglutinin__InfluenzaA__AHL96366
augaagacuaucauugcuuugagcuacauucuaugucugguuuucgcucaaaaacuuccugaaaaugacaauagcacggcaacgcugugccuugggcaccaugcaguaccaaacggaacgauagugaaaacaaucacgaaugaccgaauugaagucacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggggucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaaccagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41960 - RNA, 1701 nt, Artificial Sequence; identical to SEQ ID NO: 40984
  hemagglutinin__InfluenzaA__AHL96378

SEQ ID NO: 41961 - RNA, 1701 nt, Artificial Sequence; identical to SEQ ID NO: 40371
  hemagglutinin__InfluenzaA__AHL96390

SEQ ID NO: 41962 - RNA, 1701 nt, Artificial Sequence
  hemagglutinin__InfluenzaA__AHL96402
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauaagaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacaagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41963 - RNA, 1701 nt, Artificial Sequence; identical to SEQ ID NO: 40372
  hemagglutinin__InfluenzaA__AHL96414

SEQ ID NO: 41964 - RNA, 1701 nt, Artificial Sequence; identical to SEQ ID NO: 40981
  hemagglutinin__InfluenzaA__AHL96426

SEQ ID NO: 41965 - RNA, 1701 nt, Artificial Sequence
  hemagglutinin__InfluenzaA__AHL96438
augaagaccaucauugcuuugagcuacauucuaugccuaguuuucgcucaagaacuuccuggaaaugacgacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaguuccgcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 41966 - RNA, 1701 nt, Artificial Sequence
  hemagglutinin__InfluenzaA__AHL96450
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguggaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41967 - RNA, 1701 nt, Artificial Sequence; identical to SEQ ID NO: 40981
  hemagglutinin__InfluenzaA__AHL96462

SEQ ID NO: 41968 - RNA, 1701 nt, Artificial Sequence
  hemagglutinin__InfluenzaA__AHL96474
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguauccccauugcauuuggguaaauguaacauugcuggcuggauccugggaaauccagagugugaaucacucuccacagcaagcucaugguccuacauuguggaaacaucugguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaggcuucuacaaaaauuuaauauggcuaguuaaaaaaggaaauucauacccaaagcucaguauauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauuugcaauggaaagaaaugcuggaucugguauuaucauuucagauacaccaguucacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccuucuauucaaucuagaggccuauuuggggccauugcuggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgacucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugauuacccaaaauacucagaggaagcaaaauuaaacagagaagaaauagaugggguaaagcuggaaucaacaaggauuuaccagauuuuggcgaucuauucaacugccgcuaguucauugguacugguagucucccugggggcaaucaguuuuuggaugugcucuaaugggucucuacaguguagaauauguauuuaa

SEQ ID NO: 41969 - RNA, 1701 nt, Artificial Sequence
  hemagglutinin__InfluenzaA__AHL96485
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugaaaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaguugagcuuaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41970 - RNA, 1701 nt, Artificial Sequence; identical to SEQ ID NO: 40981
  hemagglutinin__InfluenzaA__AHL96497

SEQ ID NO: 41971 - RNA, 1701 nt, Artificial Sequence; identical to SEQ ID NO: 40372
  hemagglutinin__InfluenzaA__AHL96509

SEQ ID NO: 41972 - RNA, 1701 nt, Artificial Sequence; identical to SEQ ID NO: 40592
  hemagglutinin__InfluenzaA__AHL96521

SEQ ID NO: 41973 - RNA, 1701 nt, Artificial Sequence
  hemagglutinin__InfluenzaA__AHL96533
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucuuccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccucgagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41974 - RNA, 1701 nt, Artificial Sequence; identical to SEQ ID NO: 41050
  hemagglutinin__InfluenzaA__AHL96545

SEQ ID NO: 41975 - RNA, 1701 nt, Artificial Sequence
  hemagglutinin__InfluenzaA__AHL96569
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagagucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaauuguuugaaaaaacaaagaagcaacuaagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41976 - RNA, 1701 nt, Artificial Sequence; identical to SEQ ID NO: 41968
  hemagglutinin__InfluenzaA__AHL96581

SEQ ID NO: 41977 - RNA, 1701 nt, Artificial Sequence
  hemagglutinin__InfluenzaA__AHL96592
augaagacuaucauugcuuugggcuacauucuaugucugguuuucgcucaaaaaauuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuauugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41978 - RNA, 1701 nt, Artificial Sequence; identical to SEQ ID NO: 40981
  hemagglutinin__InfluenzaA__AHL96604

SEQ ID NO: 41979 - RNA, 1701 nt, Artificial Sequence; identical to SEQ ID NO: 40981
  hemagglutinin__InfluenzaA__AHL96616

SEQ ID NO: 41980 - RNA, 1701 nt, Artificial Sequence
  hemagglutinin__InfluenzaA__AHL96628
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggggggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaguugagcuuaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41981 - RNA, 1701 nt, Artificial Sequence; identical to SEQ ID NO: 41969
  hemagglutinin__InfluenzaA__AHL96640

SEQ ID NO: 41982 - RNA, 1701 nt, Artificial Sequence
  hemagglutinin__InfluenzaA__AHL96652
augaagacuaucauugcuuugagcuacauucuaugucugguuuucgcucaaaaacuuccuggaaaugacaauagcacggcaacgcugugccuugggcaccaugcaguaccaaacggaacaauagugaaaacaaucacgaaugaccgaauugaaguuacuaaugcuacugagcugguucaggauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauagugaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacacugaaauuggcaacaggaaugcgaaauguaccagagaaacaaacuagaggaauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41983 - RNA, 1701 nt, Artificial Sequence; identical to SEQ ID NO: 40971
  hemagglutinin__InfluenzaA__AHL96664

SEQ ID NO: 41984 - RNA, 1701 nt, Artificial Sequence
  hemagglutinin__InfluenzaA__AHL96676
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccgggcacggacaaggaccaaaucuuccuguaugcucaaucaucaggaagaaucacaguaucuaccaaaagaagccaacaagcuguaaucccgaauaucgggucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaauugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaccuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41985 - RNA, 1701 nt, Artificial Sequence; identical to SEQ ID NO: 40997
  hemagglutinin__InfluenzaA__AHL96688

SEQ ID NO: 41986 - RNA, 1701 nt, Artificial Sequence; identical to SEQ ID NO: 40981
  hemagglutinin__InfluenzaA__AHL96700

SEQ ID NO: 41987 - RNA, 1701 nt, Artificial Sequence; identical to SEQ ID NO: 40981
  hemagglutinin__InfluenzaA__AHL96712

SEQ ID NO: 41988 - RNA, 1701 nt, Artificial Sequence; identical to SEQ ID NO: 40984
  hemagglutinin__InfluenzaA__AHL96724

SEQ ID NO: 41989 - RNA, 1701 nt, Artificial Sequence; identical to SEQ ID NO: 40371
  hemagglutinin__InfluenzaA__AHL96748

SEQ ID NO: 41990 - RNA, 1701 nt, Artificial Sequence
  hemagglutinin__InfluenzaA__AHL96784
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagacuggauccuauggauuuccuuugccauaucauguuuuuugcuuuguguugcuuuguugggguucaucaugugggccugccaaaagggcaacauuaggugcaacauuugcauuuga

SEQ ID NO: 41991 - RNA, 1701 nt, Artificial Sequence
  hemagglutinin__InfluenzaA__AHL96796
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuauugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 41992 - RNA, 1701 nt, Artificial Sequence; identical to SEQ ID NO: 40371
  hemagglutinin__InfluenzaA__AHL96808

SEQ ID NO: 41993 - RNA, 1701 nt, Artificial Sequence; identical to SEQ ID NO: 40371
  hemagglutinin__InfluenzaA__AHL96820

SEQ ID NO: 41994 - RNA, 1701 nt, Artificial Sequence; identical to SEQ ID NO: 40372
  hemagglutinin__InfluenzaA__AHL96832

SEQ ID NO: 41995 - RNA, 1701 nt, Artificial Sequence; identical to SEQ ID NO: 40984
  hemagglutinin__InfluenzaA__AHL96844

SEQ ID NO: 41996 - RNA, 1701 nt, Artificial Sequence; identical to SEQ ID NO: 40984
  hemagglutinin__InfluenzaA__AHL96856

SEQ ID NO: 41997 - RNA, 1701 nt, Artificial Sequence
  hemagglutinin__InfluenzaA__AHL96868
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggaggaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguagucccuaauaucggaucuagacccagaauaaggaauaucccuaguagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacagggaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagagaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggauacaaagauuggauccuauggauuuccuuugccaugucauguuuuuugcuuuguguugcuuuguugggguucaucaugugggccugccaaaagggcaacauuaggugcaacauuugcauuuga

SEQ ID NO: 41998 - RNA, 1701 nt, Artificial Sequence; identical to SEQ ID NO: 40371
  hemagglutinin__InfluenzaA__AHL96880

SEQ ID NO: 41999 - RNA, 1701 nt, Artificial Sequence
  hemagglutinin__InfluenzaA__AHL96892
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugagcaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaaaucugaauguaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaguucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42000 - RNA, 1701 nt, Artificial Sequence
  hemagglutinin__InfluenzaA__AHL96904
augaagacuaucauugcuuugagcuacauucuaugucugguuuucgcucaaaaacuuccuggaaaugacaauagcacggcaacgcugugccuugggcaccaugcaguaccaaacggaaugauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguagucccuaauaucggaucuagacccagaauaaggaauaucccuaguagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacagggaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagagaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccaugucauguuuuuugcuuuguguugcuuuguugggguccaucaugugggccugccaaaagggcaacauuaggugcaacauuugcauuuga

SEQ ID NO: 42001 - RNA, 1701 nt, Artificial Sequence
  hemagglutinin__InfluenzaA__AHL96916
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaaaggaguugagcuuaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42002 - RNA, 1701 nt, Artificial Sequence; identical to SEQ ID NO: 40371
  hemagglutinin__InfluenzaA__AHL96928

SEQ ID NO: 42003 - RNA, 1701 nt, Artificial Sequence; identical to SEQ ID NO: 40371
  hemagglutinin__InfluenzaA__AHL96940

SEQ ID NO: 42004 - RNA, 1701 nt, Artificial Sequence; identical to SEQ ID NO: 40372
  hemagglutinin__InfluenzaA__AHL96952

SEQ ID NO: 42005 - RNA, 1701 nt, Artificial Sequence; identical to SEQ ID NO: 40984
  hemagglutinin__InfluenzaA__AHL96964

SEQ ID NO: 42006 - RNA, 1701 nt, Artificial Sequence; identical to SEQ ID NO: 40530
  hemagglutinin__InfluenzaA__AHL96976

SEQ ID NO: 42007 - RNA, 1701 nt, Artificial Sequence
  hemagglutinin__InfluenzaA__AHL96988
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaagaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggugccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaguugagcuuaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42008 - RNA, 1701 nt, Artificial Sequence; identical to SEQ ID NO: 40984
  hemagglutinin__InfluenzaA__AHL97000

SEQ ID NO: 42009 - RNA, 1701 nt, Artificial Sequence; identical to SEQ ID NO: 40981
  hemagglutinin__InfluenzaA__AHL97012

SEQ ID NO: 42010 - RNA, 1701 nt, Artificial Sequence
  hemagglutinin__InfluenzaA__AHL97024
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucaugaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42011 - RNA, 1701 nt, Artificial Sequence
  hemagglutinin__InfluenzaA__AHL97036
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacguaacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaacguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaauaccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42012 - RNA, 1701 nt, Artificial Sequence; identical to SEQ ID NO: 40393
  hemagglutinin__InfluenzaA__AHL97048

SEQ ID NO: 42013 - RNA, 1701 nt, Artificial Sequence
  hemagglutinin__InfluenzaA__AHL97060
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucagaauaagaaaugggaccuuuuuguugaacggagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguccaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauaagaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaacacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42014 - RNA, 1701 nt, Artificial Sequence; identical to SEQ ID NO: 40981
  hemagglutinin__InfluenzaA__AHL97072

SEQ ID NO: 42015 - RNA, 1701 nt, Artificial Sequence
  hemagglutinin__InfluenzaA__AHL97084
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcacugaacgugacuaugccaaacaaugagcaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaaaucugaauguaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42016 - RNA, 1701 nt, Artificial Sequence
  hemagglutinin__InfluenzaA__AHL97096
augaagaccaucauugcuuugagcuacauucuaugucuaguuuuugcucaagaacuuccuggaaaugacgacagcacggcaacgcugugccuugggcaccaugcagugccaaacggaacgauagugaaaacaaucacgaaugaccaaauugaaguuacuaaugcuacugaacugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguguacagagaugaagcauuaaacaaccgauuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42017 - RNA, 1701 nt, Artificial Sequence
  hemagglutinin__InfluenzaA__AHL97108
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaguacccagcauugaacgugacuaugccaaacaaugaacaauuugacaaauuguacauuugggggguucaccacccggguacggacaaggaccaaaucuuccuguaugcucaaucaucaggaagaaucacagugucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuucaccagauugagaaagaauucucagaaguagaagggagaauucaggaccuugagaaauauguugaggacacaaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42018 - RNA, 1701 nt, Artificial Sequence
  hemagglutinin__InfluenzaA__AHL97120
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugagcaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaaaucugaauguaucacuccaaauggaagcauucccaaugacaaaccauuccaaaauguaaacagggucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucauaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42019 - RNA, 1701 nt, Artificial Sequence
  hemagglutinin__InfluenzaA__AHL97132
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguagcuucuuuaguagauuaaauugguugacccacuuaaacuucaaguacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagggaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugagaaagaauucucagaaguagaagggagaauucaggaccuugagaaauauguugaggacacaaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42020 - RNA, 1701 nt, Artificial Sequence; identical to SEQ ID NO: 40981
  hemagglutinin__InfluenzaA__AHL97144

SEQ ID NO: 42021 - RNA, 1701 nt, Artificial Sequence
  hemagglutinin__InfluenzaA__AHL97156
augaagacuaucauugcuuugagcuacauucuaugucugguuuucgcucaaaaacuuccuggaaaugacaauagcacggcaacgcugugccuuggacaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42022 - RNA, 1701 nt, Artificial Sequence; identical to SEQ ID NO: 40981
  hemagglutinin__InfluenzaA__AHL97168

SEQ ID NO: 42023 - RNA, 1701 nt, Artificial Sequence
  hemagglutinin__InfluenzaA__AHL97180
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaaccagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42024 - RNA, 1701 nt, Artificial Sequence; identical to SEQ ID NO: 40981
  hemagglutinin__InfluenzaA__AHL97192

SEQ ID NO: 42025 - RNA, 1701 nt, Artificial Sequence; identical to SEQ ID NO: 40981
  hemagglutinin__InfluenzaA__AHL97204

SEQ ID NO: 42026 - RNA, 1701 nt, Artificial Sequence
  hemagglutinin__InfluenzaA__AHL97216
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42027 - RNA, 1701 nt, Artificial Sequence
  hemagglutinin__InfluenzaA__AHL97228
augaagacuaucauugcuuugagcuacauucuaugucugguuuucgcucaaaaacuuccuggaaaugacaauagcacggcaacgcugugccuugggcaccaugcaguaccaaacggaacgguagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagauccccagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauuggcugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcaggauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaaugcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagauuaagggaguugagcugaagucaggguacaaagauuggauccuauggauuuccuuugccauaucauguuuuuugcuuuguguuguuuuguugggguucaucaugugggccugccaaaagggcaacauuaggugcaacauuugcauuuga

SEQ ID NO: 42028 - RNA, 1701 nt, Artificial Sequence; identical to SEQ ID NO: 40981
  hemagglutinin__InfluenzaA__AHL97240

SEQ ID NO: 42029 - RNA, 1701 nt, Artificial Sequence
  hemagglutinin__InfluenzaA__AHL97252
augaagaccaucauugcuuugagcuacauucuaugucuaguuuuugcucaagaacuuccuggaaaugacgacagcacggcaacgcugugccuugggcaccaugcagugccaaacggaacgauagugaaaacaaucacgaaugaccaaauugaaguuacuaaugcuacugaacugguucagaguuccucaacaggugaaauaugcaacaguccucaucagauccuugauggagaaaauugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaaacuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42030 - RNA, 1701 nt, Artificial Sequence; identical to SEQ ID NO: 40540
  hemagglutinin__InfluenzaA__AHL97264

SEQ ID NO: 42031 - RNA, 1701 nt, Artificial Sequence; identical to SEQ ID NO: 40981
  hemagglutinin__InfluenzaA__AHL97276

SEQ ID NO: 42032 - RNA, 1701 nt, Artificial Sequence
  hemagglutinin__InfluenzaA__AHL97288
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcaacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaaggaauauuccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggaggggaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaauaaagaaacaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42033 - RNA, 1701 nt, Artificial Sequence; identical to SEQ ID NO: 40984
  hemagglutinin__InfluenzaA__AHL97300

SEQ ID NO: 42034 - RNA, 1701 nt, Artificial Sequence; identical to SEQ ID NO: 40981
  hemagglutinin__InfluenzaA__AHL97312

SEQ ID NO: 42035 - RNA, 1701 nt, Artificial Sequence; identical to SEQ ID NO: 40551
  hemagglutinin__InfluenzaA__AHL97336

SEQ ID NO: 42036 - RNA, 1701 nt, Artificial Sequence; identical to SEQ ID NO: 40547
  hemagglutinin__InfluenzaA__AHL97348

SEQ ID NO: 42037 - RNA, 1701 nt, Artificial Sequence
  hemagglutinin__InfluenzaA__AHL97372
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaagucacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaugccuacagcaacuguuacccuuaugaugugccggauuaugccucccuuaggucacuaguugccucauccggcacacuggaguuuaacaaugaaagcuucaauugggcuggggucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaaccagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42038 - RNA, 1701 nt, Artificial Sequence; identical to SEQ ID NO: 40981
  hemagglutinin__InfluenzaA__AHL97384

SEQ ID NO: 42039 - RNA, 1701 nt, Artificial Sequence
  hemagglutinin__InfluenzaA__AHL97396
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugcaucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaguugagcuuaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42040 - RNA, 1701 nt, Artificial Sequence; identical to SEQ ID NO: 40592
  hemagglutinin__InfluenzaA__AHL97408

SEQ ID NO: 42041 - RNA, 1701 nt, Artificial Sequence; identical to SEQ ID NO: 42010
  hemagglutinin__InfluenzaA__AHL97420

SEQ ID NO: 42042 - RNA, 1701 nt, Artificial Sequence
  hemagglutinin__InfluenzaA__AHL97444
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaagucacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggggucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacgggaccugucccagauauguuaagcaaagcacucugaaauuggcaacaggaaugcgaaauguaccagagaaacaaaccagaggcauauuuggcgcaauagcggguuucauagaaaaugguugggagggaaugguggaugguugguacgguuucaggcaucaaaauuccgagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42043 - RNA, 1701 nt, Artificial Sequence; identical to SEQ ID NO: 40984
  hemagglutinin__InfluenzaA__AHL97456

SEQ ID NO: 42044 - RNA, 1701 nt, Artificial Sequence
  hemagglutinin__InfluenzaA__AHL97468
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuagaucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaaggaauauuccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggaggggaugauggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuagaugcaacauuugcauuuga

SEQ ID NO: 42045 - RNA, 1701 nt, Artificial Sequence; identical to SEQ ID NO: 40551
  hemagglutinin__InfluenzaA__AHL97480

SEQ ID NO: 42046 - RNA, 1701 nt, Artificial Sequence; identical to SEQ ID NO: 40981
  hemagglutinin__InfluenzaA__AHL97493

SEQ ID NO: 42047 - RNA, 1701 nt, Artificial Sequence
  hemagglutinin__InfluenzaA__AHL97505
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucaugaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccaugauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42048 - RNA, 1701 nt, Artificial Sequence
  hemagglutinin__InfluenzaA__AHL97517
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucaucaggaagaaucacaguaucuacccaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaguugagcuuaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42049 - RNA, 1701 nt, Artificial Sequence
  hemagglutinin__InfluenzaA__AHL97529
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaaagaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagacgcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagagaaaaugcugaggauaugggcaaugguuguuucaaaauauaccacaaaugugacaaugccugcauaggaucaaucagaaauggaacuuaugaccacgauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42050 - RNA, 1701 nt, Artificial Sequence
  hemagglutinin__InfluenzaA__AHL97541
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuucagaucaagggaguugagcuaaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42051 - RNA, 1701 nt, Artificial Sequence
  hemagglutinin__InfluenzaA__AHL97553
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacggagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugagcaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaaaucugaauguaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42052 - RNA, 1701 nt, Artificial Sequence
  hemagglutinin__InfluenzaA__AHL97565
augaagaccaucauugcuuugagcuacauucuaugucuaguuuucgcucaagaacuuccuggaaaugacgacagcacggcaacacugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccagauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcagguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaagcuguuugaaaaaacaaagaagcaacugagggaaaaugcugaggauaugggcaaugguuguuucaaaauauaccacaaaugugacaaugccugcauaggaucaaucagaaauggaacuuaugaucacgauguguacagagaugaagcauuaaacaaccgauuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42053 - RNA, 1701 nt, Artificial Sequence
  hemagglutinin__InfluenzaA__AHL97577
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauaagaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagccaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42054 - RNA, 1701 nt, Artificial Sequence
  hemagglutinin__InfluenzaA__AHL97589
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacagcccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauaagaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggacgaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42055 - RNA, 1701 nt, Artificial Sequence; identical to SEQ ID NO: 40981
  hemagglutinin__InfluenzaA__AHL97601

SEQ ID NO: 42056 - RNA, 1701 nt, Artificial Sequence
  hemagglutinin__InfluenzaA__AHL97613
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacccaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaguugagcuuaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42057 - RNA, 1701 nt, Artificial Sequence; identical to SEQ ID NO: 42044
  hemagglutinin__InfluenzaA__AHL97625

SEQ ID NO: 42058 - RNA, 1701 nt, Artificial Sequence; identical to SEQ ID NO: 40984
  hemagglutinin__InfluenzaA__AHL97637

SEQ ID NO: 42059 - RNA, 1701 nt, Artificial Sequence
  hemagglutinin__InfluenzaA__AHL97661
augaagacuaucauugcuuugggcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaguugagcuuaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42060 - RNA, 1701 nt, Artificial Sequence
  hemagglutinin__InfluenzaA__AHL97673
augaagaccaccauugcuuugagcuacauucuaugucuaguuuuugcucaagaacuuccuggaaaugacgacagcacggcaacgcugugccuugggcaccaugcagugccaaacggaacgauagugaaaacaaucacgaaugaccaaauugaaguuacuaaugcuacugaacugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42061 - RNA, 1701 nt, Artificial Sequence; identical to SEQ ID NO: 40981
  hemagglutinin__InfluenzaA__AHL97685

SEQ ID NO: 42062 - RNA, 1701 nt, Artificial Sequence
  hemagglutinin__InfluenzaA__AHL97697
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaggcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugagcaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaaaucugaauguaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugauagggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42063 - RNA, 1701 nt, Artificial Sequence; identical to SEQ ID NO: 40984
  hemagglutinin__InfluenzaA__AHL97709

SEQ ID NO: 42064 - RNA, 1701 nt, Artificial Sequence
  hemagglutinin__InfluenzaA__AHL97721
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugagcaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauaagaagugggaaaagcucaauaaugagaucagaugcacccauuggcaaaugcaaaucugaauguaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42065 - RNA, 1701 nt, Artificial Sequence
  hemagglutinin__InfluenzaA__AHL97733
augaagacuaucauugcuuugagcuacauucuaugucugguuuucgcucaaaaacuuccuggaaaugacaauagcacggcaacgcugugccuugggcaccaugcaguaccaaacgggacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42066 - RNA, 1701 nt, Artificial Sequence; identical to SEQ ID NO: 40371
  hemagglutinin__InfluenzaA__AHL97745

SEQ ID NO: 42067 - RNA, 1701 nt, Artificial Sequence; identical to SEQ ID NO: 40981
  hemagglutinin__InfluenzaA__AHL97757

SEQ ID NO: 42068 - RNA, 1701 nt, Artificial Sequence; identical to SEQ ID NO: 40981
  hemagglutinin__InfluenzaA__AHL97769

SEQ ID NO: 42069 - RNA, 1701 nt, Artificial Sequence
  hemagglutinin__InfluenzaA__AHL97781
augaagaccaucauugcuuugagcuacauucuaugucuaguuuucgcucaagaacuuccuggaaaugacgacagcacggcaacacugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccagauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacgguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaacagcucaauaaugagaucagaugcacccauuggcaaaugcaauucuacaugcaucacuccaaauggaagcauucccaaugacaaaccauuccaaaauguaaacaggaucacauacggggccugucccagauaugucaagcaaaacacucuuaaauuggcaacaggaaugagaaauguaccagagaaacaaacuagaggcauauuuggcgcaauagcagguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguguacagagaugaagcauuaaacaaccgauuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42070 - RNA, 1701 nt, Artificial Sequence
  hemagglutinin__InfluenzaA__AHL97793
augaagacuaucauugcuuugagcuacauucuaugucuaguuuucgcucaaaaacuuccuggaaaugacaauagcacggcaacgcugugccuugggcaccaugcaguaccaaacggaacgauagugaaaacaaucacgaaugaccgaauugaagucacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggggucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaaccagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42071 - RNA, 1701 nt, Artificial Sequence
  hemagglutinin__InfluenzaA__AHL97805
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaagucacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggggucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaaccagaggcauauuuggcgcaauagcggguuucauagaaaaugguugggagggaaugguggaugguugguacgguuucaggcaucaaaauuaugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42072 - RNA, 1701 nt, Artificial Sequence
  hemagglutinin__InfluenzaA__AHL97817
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccgggcacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42073 - RNA, 1701 nt, Artificial Sequence; identical to SEQ ID NO: 42062
  hemagglutinin__InfluenzaA__AHL97829

SEQ ID NO: 42074 - RNA, 1701 nt, Artificial Sequence; identical to SEQ ID NO: 40981
  hemagglutinin__InfluenzaA__AHL97841

SEQ ID NO: 42075 - RNA, 1701 nt, Artificial Sequence; identical to SEQ ID NO: 40981
  hemagglutinin__InfluenzaA__AHL97853

SEQ ID NO: 42076 - RNA, 1701 nt, Artificial Sequence
  hemagglutinin__InfluenzaA__AHL97865
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaagucacuaaugcuacugagcugguucagaauuccucaauaggugaaauaugcgacaguccucaucagauccuugauggagaaaacugcacacuaauagaugcucuauugggagacccccagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggggucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaaccagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42077 - RNA, 1701 nt, Artificial Sequence
  hemagglutinin__InfluenzaA__AHL97877
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugagcaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauaagaagugggaaaagcucaauaaugagaucagaugcacccauuggcaaaugcaaaucugaauguaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaccuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42078 - RNA, 1701 nt, Artificial Sequence; identical to SEQ ID NO: 41909
  hemagglutinin__InfluenzaA__AHL97889

SEQ ID NO: 42079 - RNA, 1701 nt, Artificial Sequence; identical to SEQ ID NO: 40984
  hemagglutinin__InfluenzaA__AHL97901

SEQ ID NO: 42080 - RNA, 1701 nt, Artificial Sequence
  hemagglutinin__InfluenzaA__AHL97913
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacaggaaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaguugagcuuaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42081 - RNA, 1701 nt, Artificial Sequence
  hemagglutinin__InfluenzaA__AHL97925
augaagacuaucauugcuuugagcuacauucuaugucuaguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaacggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggugcaauagcggguuucauagaaaaugguugggagggaaugauggaugguugguacgguuucaggcaccaaaauucugagggaagaggacaagcagcagaucucaaaagcacucaagcagcaaucgaucaaaucaaugggaagcugaaucgauugaucgggaaaaccaacgagaaauuccaucagauugaaaaagaauuuucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcuacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42082 - RNA, 1701 nt, Artificial Sequence
  hemagglutinin__InfluenzaA__AHL97937
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagguuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaguugagcuuaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42083 - RNA, 1701 nt, Artificial Sequence
  hemagglutinin__InfluenzaA__AHL97949
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaagucacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggggucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacgggaccugucccagauauguuaagcaaagcacucugaaauuggcaacaggaaugcgaaauguaccagagaaacaaaccagaggcauauuuggcgcaauagcggguuucauagaaaaugguugggagggaaugguggaugguugguacgguuucaggcaucaaaauuccgagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggaaaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42084 - RNA, 1701 nt, Artificial Sequence
  hemagglutinin__InfluenzaA__AHL97961
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggugcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucggaaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuagaugcaacauuugcauuuga

SEQ ID NO: 42085 - RNA, 1701 nt, Artificial Sequence; identical to SEQ ID NO: 40372
  hemagglutinin__InfluenzaA__AHL97973

SEQ ID NO: 42086 - RNA, 1701 nt, Artificial Sequence; identical to SEQ ID NO: 41930
  hemagglutinin__InfluenzaA__AHL97985

SEQ ID NO: 42087 - RNA, 1701 nt, Artificial Sequence
  hemagglutinin__InfluenzaA__AHL97997
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaacguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaggggaguugagcugaagucaggguacaaagauuggauccuauggauuuccuuugccauaucauguuuuuugcuuuguguugcuuuguugggguucaucaugugggcuugccaaaagggcaacauuaggugcaacauuugcauuuga

SEQ ID NO: 42088 - RNA, 1701 nt, Artificial Sequence; identical to SEQ ID NO: 40997
  hemagglutinin__InfluenzaA__AHL98009

SEQ ID NO: 42089 - RNA, 1701 nt, Artificial Sequence
  hemagglutinin__InfluenzaA__AHL98021
augaagacuaucauugcuuugagcuacauucuaugucugguuuucgcucaaaaacuuccuggaaaugacaauagcacggcaacgcugugccuugggcaccaugcaguaccaaacggaacgauaguaaaaacaaucacgaaugaccgaauugaaguuacuaaugcuacugagcugguucagaauuccucaauagguaaaauaugcgacaguccucaucagauccuugauggagaaaauugcacacuaauggaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaguugagcuuaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42090 - RNA, 1701 nt, Artificial Sequence; identical to SEQ ID NO: 40984
  hemagglutinin__InfluenzaA__AHL98033

SEQ ID NO: 42091 - RNA, 1701 nt, Artificial Sequence
  hemagglutinin__InfluenzaA__AHL98045
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugaaaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauacguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaguugagcuuaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42092 - RNA, 1701 nt, Artificial Sequence; identical to SEQ ID NO: 42091
  hemagglutinin__InfluenzaA__AHL98057

SEQ ID NO: 42093 - RNA, 1701 nt, Artificial Sequence; identical to SEQ ID NO: 42091
  hemagglutinin__InfluenzaA__AHL98069

SEQ ID NO: 42094 - RNA, 1701 nt, Artificial Sequence
  hemagglutinin__InfluenzaA__AHL98081
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuacccaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaauguaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauuggucgggaaaaccaacgagaaauuccaucagauugaaaaggaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42095 - RNA, 1701 nt, Artificial Sequence; identical to SEQ ID NO: 42080
  hemagglutinin__InfluenzaA__AHL98093

SEQ ID NO: 42096 - RNA, 1701 nt, Artificial Sequence
  hemagglutinin__InfluenzaA__AHL98105
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucugguucagacaauggaacguguuacccaggagauuucaucgauuaugaggagcuaagagagcaauugagcucagugucaucauuugaaagguuugaaauauuccccaaaacaaguucauggccaaaucaugacucgaacaaagguguaacggcagcauguccucaugcuggagcaaaaggcuucuacaaaaauuuaauauggcuaguuaaaaaaggaaauucauacccaaagcucagcauauccuacauuaaugacaaagggaaagaaguccucgugcuauggggcauucaccauccaucuacuacugcugaccaacaaagucucuaucagaaugcagauacauauguuuuugugggggcaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauuugcaauggaaagaaaugcuggaucugguauuaucauuucagauacaccaguucacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugcuggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugauuacccaaaauacucagaggaagcaaaauuaaacagagaagaaauagaugggguaaagcuggaaucaacaaggauuuaccagauuuuggcgaucuauucaacugccgcuaguucauugguacugguagucucccugggggcaaucaguuuuuggaugugcucuaaugggucucuacaguguagaauauguauuuaa

SEQ ID NO: 42097 - RNA, 1701 nt, Artificial Sequence
  hemagglutinin__InfluenzaA__AHL98116
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucagaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42098 - RNA, 1701 nt, Artificial Sequence; identical to SEQ ID NO: 41966
  hemagglutinin__InfluenzaA__AHL98128

SEQ ID NO: 42099 - RNA, 1701 nt, Artificial Sequence; identical to SEQ ID NO: 40362
  hemagglutinin__InfluenzaA__AHL98140

SEQ ID NO: 42100 - RNA, 1701 nt, Artificial Sequence
  hemagglutinin__InfluenzaA__AHL98152
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccaggcacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42101 - RNA, 1701 nt, Artificial Sequence; identical to SEQ ID NO: 41966
  hemagglutinin__InfluenzaA__AHL98164

SEQ ID NO: 42102 - RNA, 1701 nt, Artificial Sequence; identical to SEQ ID NO: 41966
  hemagglutinin__InfluenzaA__AHL98176

SEQ ID NO: 42103 - RNA, 1701 nt, Artificial Sequence; identical to SEQ ID NO: 40362
  hemagglutinin__InfluenzaA__AHL98188

SEQ ID NO: 42104 - RNA, 1701 nt, Artificial Sequence; identical to SEQ ID NO: 40527
  hemagglutinin__InfluenzaA__AHL98200

SEQ ID NO: 42105 - RNA, 1701 nt, Artificial Sequence; identical to SEQ ID NO: 40371
  hemagglutinin__InfluenzaA__AHL98212

SEQ ID NO: 42106 - RNA, 1701 nt, Artificial Sequence
  hemagglutinin__InfluenzaA__AHL98224
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaauggaugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaguugagcuuaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42107 - RNA, 1701 nt, Artificial Sequence
  hemagglutinin__InfluenzaA__AHL98236
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaagucacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggggucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaaacaaagcacucugaaauuggcaacaggaaugcgaaauguaccagagaaacaaaccagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42108 - RNA, 1701 nt, Artificial Sequence; identical to SEQ ID NO: 41966
  hemagglutinin__InfluenzaA__AHL98248

SEQ ID NO: 42109 - RNA, 1701 nt, Artificial Sequence
  hemagglutinin__InfluenzaA__AHL98260
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggaggggaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuaguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaguugagcuuaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42110 - RNA, 1701 nt, Artificial Sequence
  hemagglutinin__InfluenzaA__AHL98272
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacauuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauagcaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42111 - RNA, 1701 nt, Artificial Sequence
  hemagglutinin__InfluenzaA__AHL98284
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguauccccauugcauuuggguaaauguaacauugcuggcuggauccugggaaauccagagugugaaucacucuccacagcaagcucaugguccuacauuguggaaacaucugguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaggcuucuacaaaaauuuaauauggcuaguuaaaaaaggaaauucauacccaaagcucagcauauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauuugcaauggaaagaaaugcuggaucugguauuaucauuucagauacaccaguucacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccuucuauucaaucuagaggccuauuuggggccauugcuggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugauuacccaaaauacucagaggaagcaaaauuaaacagagaagaaauagaugggguaaagcuggaaucaacaaggauuuaccagauuuuggcgaucuauucaacugccgcuaguucauugguacugguagucucccugggggcaaucaguuuuuggaugugcucuaaugggucucuacaguguagaauauguauuuaa

SEQ ID NO: 42112 - RNA, 1701 nt, Artificial Sequence
  hemagglutinin__InfluenzaA__AHL98295
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42113 - RNA, 1701 nt, Artificial Sequence; identical to SEQ ID NO: 42047
  hemagglutinin__InfluenzaA__AHL98307

SEQ ID NO: 42114 - RNA, 1701 nt, Artificial Sequence; identical to SEQ ID NO: 40984
  hemagglutinin__InfluenzaA__AHL98319

SEQ ID NO: 42115 - RNA, 1701 nt, Artificial Sequence
  hemagglutinin__InfluenzaA__AHL98331
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacuuacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42116 - RNA, 1701 nt, Artificial Sequence; identical to SEQ ID NO: 40551
  hemagglutinin__InfluenzaA__AHL98343

SEQ ID NO: 42117 - RNA, 1701 nt, Artificial Sequence; identical to SEQ ID NO: 42047
  hemagglutinin__InfluenzaA__AHL98354

SEQ ID NO: 42118 - RNA, 1701 nt, Artificial Sequence; identical to SEQ ID NO: 40371
  hemagglutinin__InfluenzaA__AHL98366

SEQ ID NO: 42119 - RNA, 1701 nt, Artificial Sequence; identical to SEQ ID NO: 40371
  hemagglutinin__InfluenzaA__AHL98378

SEQ ID NO: 42120 - RNA, 1701 nt, Artificial Sequence
  hemagglutinin__InfluenzaA__AHL98390
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguuaacccacuuaaacuucaaauacccagcauugaacgugacuaugccaaacaaugaacaauuugacaaauuguacauuuggggaguucaccacccggguacggacaaggaccaaaucuuccuguaugcucaaucaucaggaagaaucacaguaucuaccaaaaggagccaacaagcuguaaucccaaauaucggaucuagacccagaauaaggaauaucccuagcagaauaagcaucuauuggacaauaguaaaaccgggagacauacuuuugauuaacagcacaggaaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaguugagcuuaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42121 - RNA, 1701 nt, Artificial Sequence
  hemagglutinin__InfluenzaA__AHL98402
augaagacuauuauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaacaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauagggucaauaagaaauggaacuuaugaccacaauguguacagggaugaagcauuaaacaaccgguuccagaucaaaggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42122 - RNA, 1701 nt, Artificial Sequence
  hemagglutinin__InfluenzaA__AHL98414
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaacugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42123 - RNA, 1701 nt, Artificial Sequence
  hemagglutinin__InfluenzaA__AHL98426
augaagacuaucauugcuuugagcuacauucuaugucuaguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugaucaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaaccggaucacauauggggccugucccagauauguuaagcaaagcacucugaaauuggcaacaggaaugcgaaauguaccagagaaacaaacuagaggcauauuuggugcaauagcggguuucauagaaaaugguugggagggaaugauggaugguugguacgguuucaggcaccaaaauucugagggaagaggacaagcagcagaucucaaaagcacucaagcagcaaucgaucaaaucaaugggaagcugaaucgauugaucgggaaaaccaacgagaaauuccaucagauugaaaaagaauuuucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccaggucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42124 - RNA, 1701 nt, Artificial Sequence
  hemagglutinin__InfluenzaA__AHL98438
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauccaccauccaucuacuacugcugaccaacaaagucucuaucagaaugcagaugcauauguuuuuguggggacaucaagauacagcaaaaaguucaagccggaaauagcaauaagacccaaagugagagaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccgaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaucuggaaaaaagaauagagaauuuaaauaaaaaaguugaugaugguuuccuggacauuuggacuuacaaugccgaacucuugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaauguagaauauguauuuaa

SEQ ID NO: 42125 - RNA, 1701 nt, Artificial Sequence; identical to SEQ ID NO: 42124
  hemagglutinin__InfluenzaA__AHL98449

SEQ ID NO: 42126 - RNA, 1701 nt, Artificial Sequence
  hemagglutinin__InfluenzaA__AHL98471
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaaacauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucaguaucaucauuugaaaaguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagagaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaauagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42127 - RNA, 1701 nt, Artificial Sequence
  hemagglutinin__InfluenzaA__AHL98482
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccagguacagacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaagcuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42128 - RNA, 1701 nt, Artificial Sequence; identical to SEQ ID NO: 40592
  hemagglutinin__InfluenzaA__AHL98494

SEQ ID NO: 42129 - RNA, 1701 nt, Artificial Sequence
  hemagglutinin__InfluenzaA__AHL98506
augaagacuaucauugcuuugagcuacauucuaugucugguuuucgcucaaaaacuuccuggaaaugacaauagcacggcaacgcugugccuuggacaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaucacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42130 - RNA, 1701 nt, Artificial Sequence; identical to SEQ ID NO: 40981
  hemagglutinin__InfluenzaA__AHL98518

SEQ ID NO: 42131 - RNA, 1701 nt, Artificial Sequence; identical to SEQ ID NO: 40592
  hemagglutinin__InfluenzaA__AHL98530

SEQ ID NO: 42132 - RNA, 1701 nt, Artificial Sequence; identical to SEQ ID NO: 42129
  hemagglutinin__InfluenzaA__AHL98542

SEQ ID NO: 42133 - RNA, 1701 nt, Artificial Sequence; identical to SEQ ID NO: 42129
  hemagglutinin__InfluenzaA__AHL98554

SEQ ID NO: 42134 - RNA, 1701 nt, Artificial Sequence; identical to SEQ ID NO: 40984
  hemagglutinin__InfluenzaA__AHL98566

SEQ ID NO: 42135 - RNA, 1701 nt, Artificial Sequence; identical to SEQ ID NO: 40372
  hemagglutinin__InfluenzaA__AHL98578

SEQ ID NO: 42136 - RNA, 1701 nt, Artificial Sequence; identical to SEQ ID NO: 40997
  hemagglutinin__InfluenzaA__AHL98590

SEQ ID NO: 42137 - RNA, 1701 nt, Artificial Sequence; identical to SEQ ID NO: 40988
  hemagglutinin__InfluenzaA__AHL98602

SEQ ID NO: 42138 - RNA, 1701 nt, Artificial Sequence; identical to SEQ ID NO: 40592
  hemagglutinin__InfluenzaA__AHL98614

SEQ ID NO: 42139 - RNA, 1701 nt, Artificial Sequence
  hemagglutinin__InfluenzaA__AHL98626
augaagaccaucauugcuuugagcuacauucuaugucuaguuuuugcucaagaacuuccuggaaaugacgacagcacggcaacgcugugccuugggcaccaugcagugccaaacggaacgauagugaaaacaaucacgaaugaccaaauugaaguuacuaaugcuacugaacugguucagaguuccucaacaggugaaauaugcaacaguccucaucagauccuugauggagaaaacugcacacuaauagaugcucuauugggagacccucagugugauggcuuccaaaacaagagaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42140 - RNA, 1701 nt, Artificial Sequence
  hemagglutinin__InfluenzaA__AHL98638
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugccacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggauuacauacggggccugucccagauauguuaagcaaagcacccugaaauuggcaacaggaaugcgaaauguaccagagaaacaaacuagaggcauauuuggugcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggcaugccaaaagggcaacauuaggugcaacauuugcauuuga

SEQ ID NO: 42141 - RNA, 1701 nt, Artificial Sequence; identical to SEQ ID NO: 40984
  hemagglutinin__InfluenzaA__AHL98650

SEQ ID NO: 42142 - RNA, 1701 nt, Artificial Sequence
  hemagglutinin__InfluenzaA__AHL98662
augaagacuaucauugcuuugagcuacauucuaugucuaguuuucgcucaaaaacuuccuggaaaugacaauagcacggcaacgcugugccuugggcaccaugcaguaccaaacggaacgauggugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggugcaauagcggguuucauagaaaaugguugggagggaaugauggaugguugguacgguuucaggcaccaaaauucugagggaagaggacaagcagcagaucucaaaagcacucaagcagcaaucgaucaaaucaaugggaagcugaaucgauugaucgggaaaaccaacgagaaauuccaucagauugaaaaagaauuuucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42143 - RNA, 1701 nt, Artificial Sequence; identical to SEQ ID NO: 42010
  hemagglutinin__InfluenzaA__AHL98674

SEQ ID NO: 42144 - RNA, 1701 nt, Artificial Sequence; identical to SEQ ID NO: 40371
  hemagglutinin__InfluenzaA__AHL98686

SEQ ID NO: 42145 - RNA, 1701 nt, Artificial Sequence; identical to SEQ ID NO: 41025
  hemagglutinin__InfluenzaA__AHL98699

SEQ ID NO: 42146 - RNA, 1701 nt, Artificial Sequence
  hemagglutinin__InfluenzaA__AHL98711
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaaggugugacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaauagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggagaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42147 - RNA, 1701 nt, Artificial Sequence; identical to SEQ ID NO: 40971
  hemagglutinin__InfluenzaA__AHL98722

SEQ ID NO: 42148 - RNA, 1701 nt, Artificial Sequence
  hemagglutinin__InfluenzaA__AHL98734
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42149 - RNA, 1701 nt, Artificial Sequence; identical to SEQ ID NO: 40547
  hemagglutinin__InfluenzaA__AHL98746

SEQ ID NO: 42150 - RNA, 1701 nt, Artificial Sequence; identical to SEQ ID NO: 42148
  hemagglutinin__InfluenzaA__AHL98758

SEQ ID NO: 42151 - RNA, 1701 nt, Artificial Sequence; identical to SEQ ID NO: 40540
  hemagglutinin__InfluenzaA__AHL98770

SEQ ID NO: 42152 - RNA, 1701 nt, Artificial Sequence; identical to SEQ ID NO: 41002
  hemagglutinin__InfluenzaA__AHL98782

SEQ ID NO: 42153 - RNA, 1701 nt, Artificial Sequence
  hemagglutinin__InfluenzaA__AHL98794
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucuuccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaggucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccucgagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42154 - RNA, 1701 nt, Artificial Sequence
  hemagglutinin__InfluenzaA__AHL98806
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaagucacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggggucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaaccagaggcauauuuggcgcaauagcggguuucauagaaaaugguugggagggaaugguggaugguugguacgguuucaggcaucaaaauucugagggaagaggacaagcagcagaucucaaaagcacucaaacagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42155 - RNA, 1701 nt, Artificial Sequence; identical to SEQ ID NO: 40371
  hemagglutinin__InfluenzaA__AHL98818

SEQ ID NO: 42156 - RNA, 1701 nt, Artificial Sequence; identical to SEQ ID NO: 40984
  hemagglutinin__InfluenzaA__AHL98830

SEQ ID NO: 42157 - RNA, 1701 nt, Artificial Sequence; identical to SEQ ID NO: 40371
  hemagglutinin__InfluenzaA__AHL98842

SEQ ID NO: 42158 - RNA, 1701 nt, Artificial Sequence
  hemagglutinin__InfluenzaA__AHL98854
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaguugagcuuaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42159 - RNA, 1701 nt, Artificial Sequence
  hemagglutinin__InfluenzaA__AHL98878
augaagacuaucauugcuuugagcuacauucuaugucugguuuucacucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaucacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42160 - RNA, 1701 nt, Artificial Sequence
  hemagglutinin__InfluenzaA__AHL98890
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugagcaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaaaucugaauguaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucaugucuuuugcuuuguguugcuuuguugggguucaucaugugggccugccaaaagggcaacauuaggugcaacauuugcauuuga

SEQ ID NO: 42161 - RNA, 1701 nt, Artificial Sequence
  hemagglutinin__InfluenzaA__AHL98902
augaagacuaucauugcuuugagcuacauucuaugucugguuuucgcucaaaaacuuccuggaaaugacaauagcacggcaacgcugugccuugggcaccaugcaguaccaaacggaacgguagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugagcaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaaaucugaauguaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42162 - RNA, 1701 nt, Artificial Sequence; identical to SEQ ID NO: 40984
  hemagglutinin__InfluenzaA__AHL98913

SEQ ID NO: 42163 - RNA, 1701 nt, Artificial Sequence; identical to SEQ ID NO: 40371
  hemagglutinin__InfluenzaA__AHL98925

SEQ ID NO: 42164 - RNA, 1701 nt, Artificial Sequence; identical to SEQ ID NO: 41863
  hemagglutinin__InfluenzaA__AHL98937

SEQ ID NO: 42165 - RNA, 1701 nt, Artificial Sequence; identical to SEQ ID NO: 40551
  hemagglutinin__InfluenzaA__AHL98961

SEQ ID NO: 42166 - RNA, 1701 nt, Artificial Sequence
  hemagglutinin__InfluenzaA__AHL98973
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugaacugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguagucccuaauaucggaucuagacccagaauaaggaauaucccuaguagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacagggaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagagaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccaugucauguuuuuugcuuuguguugcuuuguugggguucaucaugugggccugccaaaagggcaacauuaggugcaacauuugcauuuga

SEQ ID NO: 42167 - RNA, 1701 nt, Artificial Sequence
  hemagglutinin__InfluenzaA__AHL98985
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugaacugguucagaauuccucaauaggugaaauaugcgacaguccucaucagauccuugauggagaaaacugcacaauaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugagcaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaaaucugaauguaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguugcuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42168 - RNA, 1701 nt, Artificial Sequence
  hemagglutinin__InfluenzaA__AHL98997
augaagacuaucauugcuuugagcuacauucuaugucugguuuucgcucaaaaacuuccuggaaaugacaauagcacggcaacacugugccuugggcaccaugcaguaccaaacggaacaauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauagugaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacacugaaauuggcaacaggaaugcgaaauguaccagagaaacaaacuagaggaauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42169 - RNA, 1701 nt, Artificial Sequence
  hemagglutinin__InfluenzaA__AHL99009
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauauccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaucacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42170 - RNA, 1701 nt, Artificial Sequence; identical to SEQ ID NO: 40372
  hemagglutinin__InfluenzaA__AHL99021

SEQ ID NO: 42171 - RNA, 1701 nt, Artificial Sequence
  hemagglutinin__InfluenzaA__AHL99045
augaagacuaucauugcuuugagcuacauucuaugccugguuuucgcucaaaaaauuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauaagaagugggaaaagcucaauaaugagaucagaugcacccauuggcaaaugcaagucugaaugcaucacuccaaauggaagcauuccaaaugacaaaccauuccaaaauguaaacaggaucacauacgggcccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacuaagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42172 - RNA, 1701 nt, Artificial Sequence
  hemagglutinin__InfluenzaA__AHL99057
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagaucauugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaaccagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42173 - RNA, 1701 nt, Artificial Sequence
  hemagglutinin__InfluenzaA__AHL99069
augaagaccaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggggacacacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauuaaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42174 - RNA, 1701 nt, Artificial Sequence
  hemagglutinin__InfluenzaA__AHL99081
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaggcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaguugagcuuaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42175 - RNA, 1701 nt, Artificial Sequence
  hemagglutinin__InfluenzaA__AHL99093
augaagacuaucauugcuuugagcuacauucuaugucugauuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaagugcaacauuugcauuuga

SEQ ID NO: 42176 - RNA, 1701 nt, Artificial Sequence
  hemagglutinin__InfluenzaA__AHL99117
augaagacuaucauugcuuugagcuacauucuaugucugguuuucgcucaaaaacuuccuggaaacgacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42177 - RNA, 1701 nt, Artificial Sequence
  hemagglutinin__InfluenzaA__AHL99129
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggacauugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauagggucaauaagaaauggaacuuaugaccacaauguguacagggaugaagcauuaaacaaccgguuccagaucaaaggaguugagcugaagucaggguacaaagauuggauccuauggauuuccuuugccauaucauguuuuuugcuuuguguugcuuuguugggguucaucauaugggccugccaaaagggcaacauuaggugcaacauuugcauuuga

SEQ ID NO: 42178 - RNA, 1701 nt, Artificial Sequence
  hemagglutinin__InfluenzaA__AHL99141
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuagacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaacguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggauacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42179 - RNA, 1701 nt, Artificial Sequence
  hemagglutinin__InfluenzaA__AHL99153
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugauguaccagauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaccccgaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42180 - RNA, 1701 nt, Artificial Sequence; identical to SEQ ID NO: 40560
  hemagglutinin__InfluenzaA__AHL99165

SEQ ID NO: 42181 - RNA, 1701 nt, Artificial Sequence; identical to SEQ ID NO: 40986
  hemagglutinin__InfluenzaA__AHL99177

SEQ ID NO: 42182 - RNA, 1701 nt, Artificial Sequence
  hemagglutinin__InfluenzaA__AHL99189
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauuaaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42183 - RNA, 1701 nt, Artificial Sequence
  hemagglutinin__InfluenzaA__AHL99225
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauacggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugaguugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42184 - RNA, 1701 nt, Artificial Sequence
  hemagglutinin__InfluenzaA__AHL99237
augaagacuaucauugcuuugagcuacauucuaugucuaguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucaaauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacucaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaccaaaauucugagggaagaggacaagcagcagaucucaagagcacucaagcagcaaucgaucaaaucaaugggaagcugaaucgauugaucgggaaaaccaacgagaaauuccaucagauugaaaaagaauuuucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42185 - RNA, 1701 nt, Artificial Sequence; identical to SEQ ID NO: 40372
  hemagglutinin__InfluenzaA__AHL99249

SEQ ID NO: 42186 - RNA, 1701 nt, Artificial Sequence; identical to SEQ ID NO: 42140
  hemagglutinin__InfluenzaA__AHL99261

SEQ ID NO: 42187 - RNA, 1701 nt, Artificial Sequence
  hemagglutinin__InfluenzaA__AHL99273
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaguacccagcauugaacgugacuaugccaaauaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugagaaagaauucucagaaguagaagggagaauucaggaccuugagaaauauguugaggacacaaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42188 - RNA, 1701 nt, Artificial Sequence
  hemagglutinin__InfluenzaA__AHL99285
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaguugagcuuaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42189 - RNA, 1701 nt, Artificial Sequence
  hemagglutinin__InfluenzaA__AHL99297
augaagacuaucauugcuuugagcuacauucuaugucugguuuucgcucaaaaaauuccuggaaaugacaauagcacggcaacgcugugccuuggacaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauaagaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42190 - RNA, 1701 nt, Artificial Sequence
  hemagglutinin__InfluenzaA__AHL99309
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaaguuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggauccagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguggaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42191 - RNA, 1701 nt, Artificial Sequence
  hemagglutinin__InfluenzaA__AHL99321
augaagacuaucauugcuuugagcuacauucuaugucugguuuuuacucaaaaacuuccuggaaaugacaauagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacgcuggaguuuaacaaugaaagcuucaauugggcuggagucacucaaaacggaacaaguucugcuugcauaaggggaucuaauaguaguuucuuuaguagauuaaauugguugacccacuuaaacuucaaguacccagcauugaacgugacuaugccaaacaaugaacaauuugacaaauuguacauuugggggguucaccacccggguacggacaaggaccaaaucuuccuguaugcccaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugagaaagaauucucagaaguagaagggagaauucaggaccuugagaaauauguugaggacacaaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42192 - RNA, 1701 nt, Artificial Sequence
  hemagglutinin__InfluenzaA__AHL99333
augaagaccaucauugcuuugagcuacauucuaugccuaguuuucgcucaagaacucccuggaaaugacgacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacaauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42193 - RNA, 1701 nt, Artificial Sequence
  hemagglutinin__InfluenzaA__AHL99356
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacuuuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaaaauacagcaagaaguucaagccggaaauagcaauaagacccaaagugagggaucaagaagggagaaugaacuauuacuggacacuaauagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguaugugaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42194 - RNA, 1701 nt, Artificial Sequence; identical to SEQ ID NO: 40393
  hemagglutinin__InfluenzaA__AHL99367

SEQ ID NO: 42195 - RNA, 1701 nt, Artificial Sequence
  hemagglutinin__InfluenzaA__AHL99379
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucugguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaggcuucuacaaaaauuuaauauggcuaguuaaaaaaggaaauucauacccaaagcucagcauauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauuugcaauggaaagaaaugcuggaucugguauuaucauuucagauacaccaguucacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugcuggcuucauugaagggggauggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaagaaauuggaaauggcugcuuugaauuuuaccacaaaugcgauaacacgugcauggaaagugucaaaaaugggacuuaugauuacccaaaauacucagaggaagcaaaauuaaacagagaaaaaauagaugggguaaagcuggaaucaacaaggauuuaccagauuuuggcgaucuauucaacugccgcuaguucauugguacugguagucucccugggggcaaucaguuuuuggaugugcucuaaugggucucuacaguguagaauauguauuuga

SEQ ID NO: 42196 - RNA, 1701 nt, Artificial Sequence
  hemagglutinin__InfluenzaA__AHL99390
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucaaaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42197 - RNA, 1701 nt, Artificial Sequence; identical to SEQ ID NO: 40540
  hemagglutinin__InfluenzaA__AHL99402

SEQ ID NO: 42198 - RNA, 1701 nt, Artificial Sequence
  hemagglutinin__InfluenzaA__AHL99426
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaaugaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaacguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugcgacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42199 - RNA, 1701 nt, Artificial Sequence
  hemagglutinin__InfluenzaA__AHL99438
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguugaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42200 - RNA, 1701 nt, Artificial Sequence; identical to SEQ ID NO: 41075
  hemagglutinin__InfluenzaA__AHL99450

SEQ ID NO: 42201 - RNA, 1701 nt, Artificial Sequence; identical to SEQ ID NO: 40982
  hemagglutinin__InfluenzaA__AHL99462

SEQ ID NO: 42202 - RNA, 1701 nt, Artificial Sequence; identical to SEQ ID NO: 42187
  hemagglutinin__InfluenzaA__AHL99474

SEQ ID NO: 42203 - RNA, 1701 nt, Artificial Sequence; identical to SEQ ID NO: 40527
  hemagglutinin__InfluenzaA__AHL99486

SEQ ID NO: 42204 - RNA, 1701 nt, Artificial Sequence
  hemagglutinin__InfluenzaA__AHL99498
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcgaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42205 - RNA, 1701 nt, Artificial Sequence
  hemagglutinin__InfluenzaA__AHL99510
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucaaauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42206 - RNA, 1701 nt, Artificial Sequence; identical to SEQ ID NO: 40362
  hemagglutinin__InfluenzaA__AHL99522

SEQ ID NO: 42207 - RNA, 1701 nt, Artificial Sequence
  hemagglutinin__InfluenzaA__AHL99534
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuaggggguacuucaaaauacgaagugggaaaagcucaauaaugagaucagaugcacccauuggcaaaugcaagucugaaugcaucacuccaaauggaagcaucccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42208 - RNA, 1701 nt, Artificial Sequence
  hemagglutinin__InfluenzaA__AHL99546
augaagacuaucauugcuuugagcuacauucuaugucugguuuucgcucaaaaacuuccugggaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacaggaaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaguugagcuuaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42209 - RNA, 1701 nt, Artificial Sequence
  hemagglutinin__InfluenzaA__AHL99558
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaucacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42210 - RNA, 1701 nt, Artificial Sequence
  hemagglutinin__InfluenzaA__AHL99570
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcagcuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauauaccuagcagaauaagcaucuauuggacaauagugaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauauuaagcaaagcacucugaaauuggcaacaggaaugcgaaacguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugccuuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42211 - RNA, 1701 nt, Artificial Sequence; identical to SEQ ID NO: 40540
  hemagglutinin__InfluenzaA__AHL99582

SEQ ID NO: 42212 - RNA, 1701 nt, Artificial Sequence
  hemagglutinin__InfluenzaA__AHL99594
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucugguucagacaauggaacguguuacccaggagauuucaucgauuaugaggagcuaagagagcaauugagcucagugucaucauuugaaagguuugagauauuccccaaaacaaguucauggccaaaucaugacucgaacaaagguguaacggcagcauguccucgugcuggagcaaaaggcuucuacaaaaauuuaauauggcuaguuaaaaaagggaauucauacccaaagcucagcauauccuacauuaaugacaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauuugcaauggaaagaaaugcuggaucugguauuaucauuucagauacaccaguucacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugcuggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugauuacccaaaauacucagaggaagcaaaauuaaacagagaagaaauagaugggguaaagcuggaaucaacaaggauuuaccagauuuuggcgaucuauucaacugccgcuaguucauugguacugguagucucccugggggcaaucaguuuuuggaugugcucuaaugggucucuacaguguagaauauguauuuaa

SEQ ID NO: 42213 - RNA, 1701 nt, Artificial Sequence; identical to SEQ ID NO: 40982
  hemagglutinin__InfluenzaA__AHL99605

SEQ ID NO: 42214 - RNA, 1701 nt, Artificial Sequence
  hemagglutinin__InfluenzaA__AHL99617
augaaaacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaguacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugagaaagaauucucagaaguagaagggagaauucaggaccuugagaaauauguugaggacacaaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42215 - RNA, 1701 nt, Artificial Sequence
  hemagglutinin__InfluenzaA__AHL99629
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauuaaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42216 - RNA, 1701 nt, Artificial Sequence
  hemagglutinin__InfluenzaA__AHL99641
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugaacugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucaucuggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguagucccuaauaucggaucuagacccagaauaaggaauaucccuaguagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacagggaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaccucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagagaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccaugucauguuuuuugcuuuguguugcuuuguugggguucaucaugugggccugccaaaagggcaacauuaggugcaacauuugcauuuga

SEQ ID NO: 42217 - RNA, 1701 nt, Artificial Sequence
  hemagglutinin__InfluenzaA__AHL99665
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaacuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauauaccuagcagaauaagcaucuauuggacaauagugaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauauuaagcaaagcacucugaaauuggcaacaggaaugcgaaacguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42218 - RNA, 1701 nt, Artificial Sequence
  hemagglutinin__InfluenzaA__AHL99677
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccagauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucaaauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42219 - RNA, 1701 nt, Artificial Sequence; identical to SEQ ID NO: 40511
  hemagglutinin__InfluenzaA__AHL99689

SEQ ID NO: 42220 - RNA, 1701 nt, Artificial Sequence
  hemagglutinin__InfluenzaA__AHL99701
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugauguaccagauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaccccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42221 - RNA, 1701 nt, Artificial Sequence
  hemagglutinin__InfluenzaA__AHL99713
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuauaccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaacauguuuuuugcuuuguguugcuuuguugggguucaucaugugggccugccaaaagggcaacauuaggugcaacauuugcauuuga

SEQ ID NO: 42222 - RNA, 1701 nt, Artificial Sequence
  hemagglutinin__InfluenzaA__AHL99725
augaagaccaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaaggaauauuccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggaggggaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42223 - RNA, 1701 nt, Artificial Sequence; identical to SEQ ID NO: 40564
  hemagglutinin__InfluenzaA__AHL99737

SEQ ID NO: 42224 - RNA, 1701 nt, Artificial Sequence; identical to SEQ ID NO: 42222
  hemagglutinin__InfluenzaA__AHL99748

SEQ ID NO: 42225 - RNA, 1701 nt, Artificial Sequence
  hemagglutinin__InfluenzaA__AHL99760
augaagacuaucauugcuuugagcuacauucuaugucugguuuucgcucaaaaacuuccuggaaaugacaauagcacggcaacacugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucgggucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauagggucaauaagaaauggaacuuaugaccacaauguguacagggaugaagcauuaaacaaccgguuccagaucaaaggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42226 - RNA, 1701 nt, Artificial Sequence
  hemagglutinin__InfluenzaA__AHL99772
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaaccuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42227 - RNA, 1701 nt, Artificial Sequence; identical to SEQ ID NO: 40393
  hemagglutinin__InfluenzaA__AHL99784

SEQ ID NO: 42228 - RNA, 1701 nt, Artificial Sequence
  hemagglutinin__InfluenzaA__AHL99796
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauaagaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucaugcuuuuugcuuuguguugcuuuguugggguucaucaugugggccugccaaaagggcaacauuaggugcaacauuugcauuuga

SEQ ID NO: 42229 - RNA, 1701 nt, Artificial Sequence; identical to SEQ ID NO: 42097
  hemagglutinin__InfluenzaA__AHL99808

SEQ ID NO: 42230 - RNA, 1701 nt, Artificial Sequence
  hemagglutinin__InfluenzaA__AHL99820
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuaccaaugcuacugaacugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuuuauagaaaaugguugggagggaaugguggaugguugguacgguuucaggcaucaaaauucugauggaagaggacaagcagcagaucucaaaagcacucaagcagcaaucgaucaaaucaaugggaagcugaaucgauugauugggaaaaccaacgagaaauuccaucaaauugaaaaagaauucucagaaguagaagggagaauccaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagggaugaagcauuaaacaaccgguuccagaucaagggaguugagcugaagucaggguacaaagauuggauccuauggauuuccuuugccauaucauguuuuuugcuuuguguuguuuuguugggguucaucaugugggccugccaaaagggcaacauuaggugcaacauuugcauuuga

SEQ ID NO: 42231 - RNA, 1701 nt, Artificial Sequence
  hemagglutinin__InfluenzaA__AHL99832
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucaaaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucucuaguugccucauccggcacacuggaguuuaacaaugaaagcuucaauuggacuggagucacucaaaacggaacaaguucugcuugcauaaggagauccaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42232 - RNA, 1701 nt, Artificial Sequence
  hemagglutinin__InfluenzaA__AHL99844
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaacgcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacugacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaacguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42233 - RNA, 1701 nt, Artificial Sequence
  hemagglutinin__InfluenzaA__AHL99856
augaagaccaucauugcuuugagcuacauucuaugucuaguuuuugcucaagaacuuccuggaaaugacgacagcacggcaacgcugugccuugggcaccaugcagugccaaacggaacgauagugaaaacaaucacgaaugaccaaauugaaguuacuaaugcuacugaacugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauauuggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguauacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42234 - RNA, 1701 nt, Artificial Sequence
  hemagglutinin__InfluenzaA__AHL99868
augaagaccaucauugcuuugagcuacauucuaugucuaguuuuugcucaagaacuuccuggaaaugacgacagcacggcaacgcugugccuugggcaccaugcagugccaaacggaacgauagugaaaacaaucacgaaugaccaaauugaaguuacuaaugcuacugaacugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaaaaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42235 - RNA, 1701 nt, Artificial Sequence
  hemagglutinin__InfluenzaA__AHL99880
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaguacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugagaaagaauucucagaaguagaagggagaauucaggaccuugagaaauauguugaggacacaaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42236 - RNA, 1701 nt, Artificial Sequence; identical to SEQ ID NO: 40540
  hemagglutinin__InfluenzaA__AHL99892

SEQ ID NO: 42237 - RNA, 1701 nt, Artificial Sequence
  hemagglutinin__InfluenzaA__AHL99904
augaagacuaucauugcuuugagcuacauucuaugucugguuuucgcucaaaaacuuccuggaaaugacaauagcacggcaacgcugugccuugggcaccaugcaguaccaaacggaacaauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauagugaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacacugaaauuggcaacaggaaugcgaaauguaccagagaaacaaacuagaggaauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42238 - RNA, 1701 nt, Artificial Sequence
  hemagglutinin__InfluenzaA__AHL99916
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucagaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaaugcgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugaggggagaggacaagcagcagaucucaaaagcacucaagcagcaaucgaucaaaucaaugggaagcugaaucgauugaucgggaaaaccaacgagaaauuccaucagauugaaaaagaauucucagagguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42239 - RNA, 1701 nt, Artificial Sequence
  hemagglutinin__InfluenzaA__AHL99928
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaacguaccagagaaacaaacuagaggcauauuuggcgcaauagcggguuucauagaaaaugguugggagggaaugguggaugguugguacgguuucaggcaucaaaauucugaaggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucugacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42240 - RNA, 1701 nt, Artificial Sequence
  hemagglutinin__InfluenzaA__AHL99940
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaacguaccagagaaacaaacuagaggcauauuuggcgcaauagcggguuucauagaaaaugguugggagggaaugguggaugguugguacgguuucaggcaucaaaauucugaaggaagaggacaagcagcagaucucaaaagcacucaagcagcaaucgaucaaaucaaugggaagcugaaucgauugaucgggaaaaccaacgagaaauuccaucagauugaaaaagaauucucaggaguagaagggagaauucaggaccuugagaaauauguugaggacacuaaaauagaucucuggucauacaacgcggagcuucuuguugcccuggagaaccaacauacaauugaucugacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42241 - RNA, 1701 nt, Artificial Sequence; identical to SEQ ID NO: 40362
  hemagglutinin__InfluenzaA__AHL99952

SEQ ID NO: 42242 - RNA, 1701 nt, Artificial Sequence
  hemagglutinin__InfluenzaA__AHL99964
augaagacuaucauugcuuugagcuacauucuaugucugguuuucgcucaaaaacuuccugggaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggggacccucagugugauggcuuucaaaauaagaaaugggaccuuuuuguugaacggaguaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcucuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42243 - RNA, 1701 nt, Artificial Sequence; identical to SEQ ID NO: 42239
  hemagglutinin__InfluenzaA__AHL99976

SEQ ID NO: 42244 - RNA, 1701 nt, Artificial Sequence; identical to SEQ ID NO: 42239
  hemagglutinin__InfluenzaA__AHL99988

SEQ ID NO: 42245 - RNA, 1701 nt, Artificial Sequence
  hemagglutinin__InfluenzaA__AHM00001
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucaaaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugcaugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42246 - RNA, 1701 nt, Artificial Sequence
  hemagglutinin__InfluenzaA__AHM00013
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagauauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42247 - RNA, 1701 nt, Artificial Sequence; identical to SEQ ID NO: 40372
  hemagglutinin__InfluenzaA__AHM00025

SEQ ID NO: 42248 - RNA, 1701 nt, Artificial Sequence
  hemagglutinin__InfluenzaA__AHM00037
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaacguaccagagaaacaaacuagaggcauauuuggcgcaauagcggguuucauagaaaaugguugggagggaaugguggaugguugguacgguuucaggcaucaaaauucugaaggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucugacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42249 - RNA, 1701 nt, Artificial Sequence
  hemagglutinin__InfluenzaA__AHM00061
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42250 - RNA, 1701 nt, Artificial Sequence
  hemagglutinin__InfluenzaA__AHM00073
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaauuuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42251 - RNA, 1701 nt, Artificial Sequence; identical to SEQ ID NO: 40362
  hemagglutinin__InfluenzaA__AHM00085

SEQ ID NO: 42252 - RNA, 1701 nt, Artificial Sequence
  hemagglutinin__InfluenzaA__AHM00097
augaaggcaauacuaguaguuuugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauuacauuugggaaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaacuuaauauggcuaguuaaaaaaggaaauucauacccaaagcucagcaacuccuacauuaaugauaaagggaaagaaguccucgugcuauggggcauucaccauccaucuacuacugcugaucaacaaagucucuaucaaaaugcagauacauauguuuuugugggaacaucaagauacagcaagaaguucaagccggaaauagcaauaagacccaaagugagggaucaagaagggagaaugaacuauuacuggacacugguagagccgggagacaaaauaacauucgaagcaacuggaaaucuagugguaccgagauaugcauucgcaauggaaagaaaugcuggaucugguauuaucauuucagauacaacaguccacgauugcaauacaacuugucagacacccaagggugcuauaaacaccagccuaccauuucagaauauacauccgaucacaauugggaaauguccaaaauacguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaucacgauucgaaugugaagaacuuauaugaaaagguaagaaaccaguuaaaaaacaaugccaaggaaauuggaaauggcugcuuugaauuuuaccacaaaugcgauaacaugugcauggaaaguguuaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 42253 - RNA, 1701 nt, Artificial Sequence; identical to SEQ ID NO: 42242
  hemagglutinin__InfluenzaA__AHM00108

SEQ ID NO: 42254 - RNA, 1701 nt, Artificial Sequence; identical to SEQ ID NO: 42239
  hemagglutinin__InfluenzaA__AHM00120

SEQ ID NO: 42255 - RNA, 1701 nt, Artificial Sequence
  hemagglutinin__InfluenzaA__AHM00132
augaagaccaucauugcuuugagcuacauucuaugucuaguuuucgcucaagaacuuccuggaaaugacgacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaaagaagcaaagcccacagcaacuguuacccuuaugaugugccagauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucucccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42256 - RNA, 1701 nt, Artificial Sequence
  hemagglutinin__InfluenzaA__AHM00144
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaacguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaguugagcuuaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42257 - RNA, 1701 nt, Artificial Sequence
  hemagglutinin__InfluenzaA__AHM00156
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuagcaacaggaaugcgaaacguaccagagaaacaaacuagaggcauauuuggcgcaauagcggguuucauagaaaaugguugggagggaaugguggaugguugguacgguuucaggcaucaaaauucugaaggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcucuggagaaccaacauacaauugaucugacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42258 - RNA, 1701 nt, Artificial Sequence; identical to SEQ ID NO: 40362
  hemagglutinin__InfluenzaA__AHM00168

SEQ ID NO: 42259 - RNA, 1701 nt, Artificial Sequence
  hemagglutinin__InfluenzaA__AHM00180
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaauccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaaccagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauagggucaauaagaaauggaacuuaugaccacaauguguacagggaugaagcauuaaacaaccgguuccagaucaaaggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42260 - RNA, 1701 nt, Artificial Sequence
  hemagglutinin__InfluenzaA__AHM00192
augaagaccaucauugcuuugagcuacauucuaugccuaguuuucgcucaagaacucccuggaaaugacgacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42261 - RNA, 1701 nt, Artificial Sequence
  hemagglutinin__InfluenzaA__AHM00204
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucgcuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaacguaccagagaaacaaacuagaggcauauuuggcgcaauagcggguuucauagaaaaugguugggagggaaugguggaugguugguacgguuucaggcaucaaaauucugaaggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucugacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42262 - RNA, 1701 nt, Artificial Sequence; identical to SEQ ID NO: 42239
  hemagglutinin__InfluenzaA__AHM00216

SEQ ID NO: 42263 - RNA, 1701 nt, Artificial Sequence
  hemagglutinin__InfluenzaA__AHM00228
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaauggaaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42264 - RNA, 1701 nt, Artificial Sequence; identical to SEQ ID NO: 40362
  hemagglutinin__InfluenzaA__AHM00240

SEQ ID NO: 42265 - RNA, 1701 nt, Artificial Sequence; identical to SEQ ID NO: 40362
  hemagglutinin__InfluenzaA__AHM00252

SEQ ID NO: 42266 - RNA, 1701 nt, Artificial Sequence
  hemagglutinin__InfluenzaA__AHM00264
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggacgaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42267 - RNA, 1701 nt, Artificial Sequence
  hemagglutinin__InfluenzaA__AHM00276
augaagaccaucauugcuuugagcuacauucuaugucuaguuuucgcucaagaacuuccuggaaaugacgacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaaagaagcaaagcccacagcaacuguuacccuuaugaugugccagauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42268 - RNA, 1701 nt, Artificial Sequence
  hemagglutinin__InfluenzaA__AHM00288
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaaccagaggcauauuuggcgcaauagcagguuucauagaaaaugguugggagggaaugguggaugguugguacgguuucaggcaccaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauagggucaauaagaaauggaacuuaugaccacaauguguacagggaugaagcauuaaacaaccgguuccagaucaaaggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42269 - RNA, 1701 nt, Artificial Sequence; identical to SEQ ID NO: 40362
  hemagglutinin__InfluenzaA__AHM00300

SEQ ID NO: 42270 - RNA, 1701 nt, Artificial Sequence
  hemagglutinin__InfluenzaA__AHM00312
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaacgcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacugacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaacguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuccuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42271 - RNA, 1701 nt, Artificial Sequence; identical to SEQ ID NO: 42267
  hemagglutinin__InfluenzaA__AHM00324

SEQ ID NO: 42272 - RNA, 1701 nt, Artificial Sequence; identical to SEQ ID NO: 42267
  hemagglutinin__InfluenzaA__AHM00336

SEQ ID NO: 42273 - RNA, 1701 nt, Artificial Sequence; identical to SEQ ID NO: 42239
  hemagglutinin__InfluenzaA__AHM00348

SEQ ID NO: 42274 - RNA, 1701 nt, Artificial Sequence
  hemagglutinin__InfluenzaA__AHM00360
augaagacuaucauugcuuugagcuacauucuaugucugguuuucgcucaaaaacuuccugggaaugacaauagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacuguacacuaauagaugcucuauugggggacccucagugugauggcuuucaaaauaagaaaugggaccuuuuuguugaacggaguaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcucuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42275 - RNA, 1701 nt, Artificial Sequence; identical to SEQ ID NO: 42239
  hemagglutinin__InfluenzaA__AHM00372

SEQ ID NO: 42276 - RNA, 1701 nt, Artificial Sequence
  hemagglutinin__InfluenzaA__AHM00395
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaacguaccagagaaacaaacuagaggcauauuuggagcaauagcggguuucauagaaaaugguugggagggaaugguggaugguugguacgguuucaggcaucaaaauucugaaggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucugacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42277 - RNA, 1701 nt, Artificial Sequence
  hemagglutinin__InfluenzaA__AHM00407
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagguuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42278 - RNA, 1701 nt, Artificial Sequence
  hemagglutinin__InfluenzaA__AHM00419
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugccacugagcugguucagaauuccucaauaggugaaauaugcgacaguccucaucagauccuugauggagaaaacugcacacuaauagaugcucuauugggagacccucagugcgauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugccccagauauguuaagcaaagcacucugaaauuggcaacaggaaugcggaauguaccagagaaacaaacuagaggcauauuuggugcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaagaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggcaugccaaaagggcaacauuaggugcaacauuugcauuuga

SEQ ID NO: 42279 - RNA, 1701 nt, Artificial Sequence
  hemagglutinin__InfluenzaA__AHM00443
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucaaaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42280 - RNA, 1701 nt, Artificial Sequence; identical to SEQ ID NO: 42239
  hemagglutinin__InfluenzaA__AHM00455

SEQ ID NO: 42281 - RNA, 1701 nt, Artificial Sequence; identical to SEQ ID NO: 42239
  hemagglutinin__InfluenzaA__AHM00467

SEQ ID NO: 42282 - RNA, 1701 nt, Artificial Sequence
  hemagglutinin__InfluenzaA__AHM00479
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauagcaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaacguaccagagaaacaaacuagaggcauauuuggcgcaauagcggguuucauagaaaaugguugggagggaaugguggaugguugguacgguuucaggcaucaaaauucugaaggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucugacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42283 - RNA, 1701 nt, Artificial Sequence; identical to SEQ ID NO: 42239
  hemagglutinin__InfluenzaA__AHM00491

SEQ ID NO: 42284 - RNA, 1701 nt, Artificial Sequence
  hemagglutinin__InfluenzaA__AHM00503
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguggaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42285 - RNA, 1701 nt, Artificial Sequence
  hemagglutinin__InfluenzaA__AHM00515
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuauccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42286 - RNA, 1701 nt, Artificial Sequence
  hemagglutinin__InfluenzaA__AHM00527
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccccaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaagaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42287 - RNA, 1701 nt, Artificial Sequence; identical to SEQ ID NO: 42267
  hemagglutinin__InfluenzaA__AHM00539

SEQ ID NO: 42288 - RNA, 1701 nt, Artificial Sequence
  hemagglutinin__InfluenzaA__AHM00543
augaagaccaucauugcuuugagcuacauucuaugucuaguuuuugcucaagaacuuccuggaaaugacgacagcacggcaacgcugugccuugggcaccaugcagugccaaacggaacgauagugaaaacaaucacgaaugaccaaauugaaguuacuaaugcuacugaacugguucagaguuccucaacaggugaaauaugcaacaguccucaucagauccuugauggagaaaacugcacacuaauagaugcucuauugggagacccucagugugauggcuuccagaacaagaaaugggaccuuuuuguugaacgaagcaaagcccacagcaacuguuacccuuaugaugugccggauuaugccucccuuaggucacuaguugccucauccggcacaauggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucuauggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42289 - RNA, 1701 nt, Artificial Sequence
  hemagglutinin__InfluenzaA__AHM00555
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucuuguuuuuugcuuuguguugcuuuguugggguucaucaugugggccugccaaaagggcaacauuaggugcaacauuugcauuuga

SEQ ID NO: 42290 - RNA, 1701 nt, Artificial Sequence
  hemagglutinin__InfluenzaA__AHM00567
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42291 - RNA, 1701 nt, Artificial Sequence; identical to SEQ ID NO: 40362
  hemagglutinin__InfluenzaA__AHM00579

SEQ ID NO: 42292 - RNA, 1701 nt, Artificial Sequence; identical to SEQ ID NO: 42239
  hemagglutinin__InfluenzaA__AHM00591

SEQ ID NO: 42293 - RNA, 1701 nt, Artificial Sequence
  hemagglutinin__InfluenzaA__AHM00603
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaacaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42294 - RNA, 1701 nt, Artificial Sequence; identical to SEQ ID NO: 42285
  hemagglutinin__InfluenzaA__AHM00615

SEQ ID NO: 42295 - RNA, 1701 nt, Artificial Sequence
  hemagglutinin__InfluenzaA__AHM00627
augaagacuaccauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucagaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42296 - RNA, 1701 nt, Artificial Sequence; identical to SEQ ID NO: 40362
  hemagglutinin__InfluenzaA__AHM00639

SEQ ID NO: 42297 - RNA, 1701 nt, Artificial Sequence; identical to SEQ ID NO: 42267
  hemagglutinin__InfluenzaA__AHM00651

SEQ ID NO: 42298 - RNA, 1701 nt, Artificial Sequence
  hemagglutinin__InfluenzaA__AHM00663
augaagacuaucauugcuuugagcuacauucuaugucugguuuucgcucaaaaacuuccuggaaaugacaauagcacggcaacgcugugccuuggacaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42299 - RNA, 1701 nt, Artificial Sequence; identical to SEQ ID NO: 42239
  hemagglutinin__InfluenzaA__AHM00675

SEQ ID NO: 42300 - RNA, 1701 nt, Artificial Sequence; identical to SEQ ID NO: 41449
  hemagglutinin__InfluenzaA__AHM00687

SEQ ID NO: 42301 - RNA, 1701 nt, Artificial Sequence
  hemagglutinin__InfluenzaA__AHM00698
augaagaccaucauugcuuugagcuacauucuaugucuaguuuucgcucaagaacuuccuggaaaugacgacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaaagaagcaaagcccacagcaacuguuacccuuaugaugugccagauuaugccucccuuaggucacuaguugccucauccggcacacuggaguuuaacaaugaaagcuucaauuggacuggagucacucaaaacggaacaagcucugcuugcacaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42302 - RNA, 1701 nt, Artificial Sequence; identical to SEQ ID NO: 40362
  hemagglutinin__InfluenzaA__AHM00710

SEQ ID NO: 42303 - RNA, 1701 nt, Artificial Sequence
  hemagglutinin__InfluenzaA__AHM00722
augaaaacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42304 - RNA, 1701 nt, Artificial Sequence; identical to SEQ ID NO: 40362
  hemagglutinin__InfluenzaA__AHM00734

SEQ ID NO: 42305 - RNA, 1701 nt, Artificial Sequence
  hemagglutinin__InfluenzaA__AHM00746
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaacguaccagagaaacaaacuagaggcauauuuggcgcaauagcggguuucauagaaaaugguugggagggaaugguggaugguugguacgguuucaggcaucaaaauucugaaggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucugacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42306 - RNA, 1701 nt, Artificial Sequence
  hemagglutinin__InfluenzaA__AHM00758
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucagggagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42307 - RNA, 1701 nt, Artificial Sequence; identical to SEQ ID NO: 40530
  hemagglutinin__InfluenzaA__AHM00770

SEQ ID NO: 42308 - RNA, 1701 nt, Artificial Sequence; identical to SEQ ID NO: 42267
  hemagglutinin__InfluenzaA__AHM00782

SEQ ID NO: 42309 - RNA, 1701 nt, Artificial Sequence
  hemagglutinin__InfluenzaA__AHM00794
augaagacuaucauugcuuugagcuacauucuaugucugguuuucacucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42310 - RNA, 1701 nt, Artificial Sequence
  hemagglutinin__InfluenzaA__AHM00806
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuaccccuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuuggggaguucaccacccggguacggacaaggaccaaaucuuccuguaugcucaagcagcaggaagaaucacaguaucuaccaaaagaagccaacaagcuguaauuccgaauaucggauccagacccaggguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaacggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguaugguuucaggcaucaaaauucugagggaaggggacaagcagcagaucuuaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggaacuucuuguugcccuggagaaccaacacacaauugaucuaacugauucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacuauguguacagagaugaagcauuaaacaaccgauuccagaucaagggaguugagcugaagucaggguacaaagauuggauccuauggauuuccuuugccacaucauguuuuuugcuuuguguugcuuuguugggguucaucaugugggccugccaaaaaggcaacauuaggugcaacauuugcauuuga

SEQ ID NO: 42311 - RNA, 1701 nt, Artificial Sequence
  hemagglutinin__InfluenzaA__AHM00818
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaaacuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaacguaccagagaaacaaacuagaggcauauuuggcgcaauagcggguuucauagaaaaugguugggagggaaugguggaugguugguacgguuucaggcaucaaaauucugaaggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccagcauacaauugaucugacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42312 - RNA, 1701 nt, Artificial Sequence
  hemagglutinin__InfluenzaA__AHM00830
augaagacuaucauugcuuugagcuacauucuaugucugguuuucgcgcaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaacguaccagagaaacaaacuagaggcauauuuggcgcaauagcggguuucauagaaaaugguugggagggaaugguggaugguugguacgguuucaggcaucaaaauuccgaaggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucugacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42313 - RNA, 1701 nt, Artificial Sequence
  hemagglutinin__InfluenzaA__AHM00842
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagggaugaagcauuaaacaacagguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42314 - RNA, 1701 nt, Artificial Sequence
  hemagglutinin__InfluenzaA__AHM00854
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugaaaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42315 - RNA, 1701 nt, Artificial Sequence; identical to SEQ ID NO: 42314
  hemagglutinin__InfluenzaA__AHM00866

SEQ ID NO: 42316 - RNA, 1701 nt, Artificial Sequence; identical to SEQ ID NO: 40362
  hemagglutinin__InfluenzaA__AHM00878

SEQ ID NO: 42317 - RNA, 1701 nt, Artificial Sequence; identical to SEQ ID NO: 40592
  hemagglutinin__InfluenzaA__AHM00890

SEQ ID NO: 42318 - RNA, 1701 nt, Artificial Sequence; identical to SEQ ID NO: 40372
  hemagglutinin__InfluenzaA__AHM00902

SEQ ID NO: 42319 - RNA, 1701 nt, Artificial Sequence; identical to SEQ ID NO: 42250
  hemagglutinin__InfluenzaA__AHM00914

SEQ ID NO: 42320 - RNA, 1701 nt, Artificial Sequence
  hemagglutinin__InfluenzaA__AHM00926
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccauuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42321 - RNA, 1701 nt, Artificial Sequence
  hemagglutinin__InfluenzaA__AHM00938
augaagaccaucauugcuuugagcuacauucuaugucuaguuuucgcucaagaacuuccuggaaaugacgacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaaagaagcaaagcccacagcaacuguuacccuuaugaugugccagauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaaugggacuuaugaucacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42322 - RNA, 1701 nt, Artificial Sequence
  hemagglutinin__InfluenzaA__AHM00950
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugucucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccaugucauguuuuuugcuuuguguugcuuuguugggguucaucaugugggccugccaaaagggcaacauuaggugcaacauuugcauuuga

SEQ ID NO: 42323 - RNA, 1701 nt, Artificial Sequence
  hemagglutinin__InfluenzaA__AHM00962
augaagaccaucauugcuuugagcuacauucuaugucuaguuuucgcucaagaacuuccuggaaaugacgacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaaagaagcaaagcccacagcaacuguuacccuuaugaugugccagauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauauuggaucuagacccagaguaaggaauaucccuagcagaguaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42324 - RNA, 1701 nt, Artificial Sequence
  hemagglutinin__InfluenzaA__AHM00974
augaagaccaucauugcuuugagcuacauucuaugucuaguuuucgcucaagaacuuccuggaaaugacgacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaaagaagcaaagcccacagcaacuguuacccuuaugaugugccagauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaggaaucacaguaucuaccaaaagaagccaacaagcuguaauuccgaauaucggaucuagacccagaguaaggaauaucccuagcagaguaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagagaaaaugcugaggauaugggcaaugguuguuucaaaauauaccacaaaugugacaaugccugcauaggaucaaucagaaauggaacuuaugaucacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42325 - RNA, 1683 nt, Artificial Sequence
  hemagglutinin__InfluenzaA__AHM24224
augaacacucaaauccugguauucgcucugauugcgaucauuccaacaaaugcagacaaaaucugccucggacaucaugccgugucaaacggaaccaaaguaaacacauuaacugaaagaggaguggaagucgucaaugcaacugaaacaguggaacgaacaaacauccccaggaucugcucaaaagggaaaaggacaguugaccucggucaauguggacuccuggggacaaucacuggaccaccucaaugugaccaauuccuagaauuuucagccgauuuaauuauugagaggcgagaaggaagugaugucuguuauccugggaaauucgugaaagaagaagcucugaggcaaauucucagagaaucaggcggaauugacaaggaagcaaugggauucacauacaguggaauaagaacuaauggagcaaccagugcauguaggagaucaggaucuucauucuaugcagaaaugaaauggcuccugucaaacacagauaaugcugcauucccgcagaugacuaagucauauaaaaauacaagaaaaagcccagcucuaauaguaugggggauccaucauuccguaucaacugcagagcaaaccaagcuauaugggaguggaaacaaacuggugacaguugggaguucuaauuaucaacaaucuuuuguaccgaguccaggagcgagaccacaaguuaauggucuaucuggaagaauugacuuucauuggcuaaugcuaaaucccaaugauacagucacuuucaguuucaauggggcuuucauagcuccagaccgugcaagcuuccugagaggaaaaucuaugggaauccagaguggaguacagguugaugccaauugugaaggggacugcuaucauaguggagggacaauaauaaguaacuugccauuucagaacauagauagcagggcaguuggaaaauguccgagauauguuaagcaaaggagucugcugcuagcaacagggaugaagaauguuccugagauuccaaagggaagaggccuauuuggugcuauagcggguuucauugaaaauggaugggaaggccuaauugaugguugguaugguuucagacaccagaaugcacagggagagggaacugcugcagauuacaaaagcacucaaucggcaauugaucaaauaacaggaaaauuaaaccggcuuauagaaaaaaccaaccaacaauuugaguugauagacaaugaauucaaugagguagagaagcaaaucgguaaugugauaaauuggaccagagauucuauaacagaaguguggucauacaaugcugaacucuugguagcaauggagaaccagcauacaauugaucuggcugauucagaaauggacaaacuguacgaacgagugaaaagacagcugagagagaaugcugaagaagauggcacugguugcuuugaaauauuucacaagugugaugaugacuguauggccaguauuagaaauaacaccuaugaucacagcaaauacagggaagaggcaaugcaaaauagaauacagauugacccagucaaacuaagcagcggcuacaaagaugugauacuuugguuuagcuucggggcaucauguuucauacuucuagccauuguaaugggccuugucuucauauguguaaagaauggaaacaugcggugcacuauuuguauauaa

SEQ ID NO: 42326 - RNA, 1683 nt, Artificial Sequence
  hemagglutinin__InfluenzaA__AHM24236
augaacacucaaauccugguauucgcucugauugcgaucauuccaacaaaugcagacaaaaucugccucggacaucaugccgugucaaacggaaccaaaguaaacacauuaacugaaagaggaguggaagucgucaaugcaacugaaacaguggaacgaacaaacauccccaggaucugcucaaaagggaaaaggacaguugaccucggucaauguggacuccuggggacaaucacuggaccaccucaaugugaccaauuccuagaauuuucagccgauuuaauuauugagaggcgagaaggaagugaugucuguuauccugggaaauucgugaaugaagaagcucugaggcaaauucucagagaaucaggcggaauugacaaggaagcaaugggauucacauacaguggaauaagaacuaauggagcaaccagugcauguaggagaucaggaucuucauucuaugcagaaaugaaauggcuccugucaaacacagauaaugcugcauucccgcagaugacuaagucauauaaaaauacaagaaaaagcccagcucuaauaguaugggggauccaucauuccguaucaacugcagagcaaaccaagcuauaugggaguggaaacaaacuggugacaguugggaguucuaauuaucaacaaucuuuuguaccgaguccaggagcgagaccacaaguuaauggucuaucuggaagaauugacuuucauuggcuaaugcuaaaccccaaugauacagucacuuucaguuucaauggggcuuucauagcuccagaccgugcaagcuuccugagaggaaaaucuaugggaauccagaguggaguacagguugaugccaauugugaaggggacugcuaucauaguggagggacaauaauaaguaacuugccauuucagaacauagauagcagggcaguuggaaaauguccgagauauguuaagcaaaggagucugcugcuagcaacagggaugaagaauguuccugagauuccaaagggaagaggccuauuuggugcuauagcggguuucauugaaaauggaugggaaggccuaauugaugguugguaugguuucagacaccagaaugcacagggagagggaacugcugcagauuacaaaagcacucaaucggcaauugaucaaauaacaggaaaauuaaaccggcuuauagaaaaaaccaaccaacaauuugaguugauagacaaugaauucaaugagguagagaagcaaaucgguaaugugauaaauuggaccagagauucuauaacagaaguguggucauacaaugcugaacucuugguagcaauggagaaccagcauacaauugaucuggcugauucagaaauggacaaacuguacgaacgagugaaaagacagcugagagagaaugcugaagaagauggcacugguugcuuugaaauauuucacaagugugaugaugacuguauggccaguauuagaaauaacaccuaugaucacagcaaauacagggaagaggcaaugcaaaauagaauacagauugacccagucaaacuaagcagcggcuacaaagaugugauacuuugguuuagcuucggggcaucauguuucauacuucuagccauuguaaugggccuugucuucauauguguaaagaauggaaacaugcggugcacuauuuguauauaa

SEQ ID NO: 42327 - RNA, 1683 nt, Artificial Sequence
  hemagglutinin__InfluenzaA__AHM24248
augaacacucaaauccugguauucgcucugauugcgaucauuccaacaaaugcagacaaaaucugccucggacaucaugccgugucaaacggaaccaaaguaaacacauuaacugaaagaggaguggaagucgucaaugcaacugaaacaguggaacgaacaaacauccccaggaucugcucaaaagggaaaaggacaguugaccucggccaauguggacuccuggggacaaucacuggaccaccucaaugugaccaauuccuagaauuuucagccgauuuaauuauugagaggcgagaaggaagugaugucuguuauccugggaaauucgugaaugaagaagcucugaggcaaauucucagagaaucaggcggaauugacaaggaagcaaugggauucacauacaguggaauaagaacuaauggagcaaccagugcauguaggagaucaggaucuucauucuaugcagaaaugaaauggcuccugucaaacacagauaaugcugcauucccgcagaugacuaagucauauaaaaauacaagaaaaagcccagcucuaauaguaugggggauccaucauuccguaucaacugcagagcaaaccaagcuauaugggaguggaaacaaacuggugacaguugggaguucuaauuaucaacaaucuuuuguaccgaguccaggagcgagaccacaaguuaauggucuaucuggaagaauugacuuucauuggcuaaugcuaaaucccaaugauacagucacuuucaguuucaauggggcuuucauagcuccagaccgugcaagcuuccugagaggaaaaucuaugggaauccagaguggaguacagguugaugccaauugugaaggggacugcuaucauaguggagggacaauaauaaguaacuugccauuucagaacauagauagcagggcaguuggaaaauguccgagauauguuaagcaaaggagucugcugcuagcaacagggaugaagaauguuccugagauuccaaagggaagaggccuauuuggugcuauagcggguuucauugaaaauggaugggaaggccuaauugaugguugguaugguuucagacaccagaaugcacagggagagggaacugcugcagauuacaaaagcacucaaucggcaauugaucaaauaacaggaaaauuaaaccggcuuauagaaaaaaccaaccaacaauuugaguugauagacaaugaauucaaugagguagagaagcaaaucgguaaugugauaaauuggaccagagauucuauaacagaaguguggucauacaaugcugaacucuugguagcaauggagaaccagcauacaauugaucuggcugauucagaaauggacaaacuguacgaacgagugaaaagacagcugagagagaaugcugaagaagauggcacugguugcuuugaaauauuucacaagugugaugaugacuguauggccaguauuagaaauaacaccuaugaucacagcaaauacagggaagaggcaaugcaaaauagaauacagauugacccagucaaacuaagcagcggcuacaaagaugugauacuuugguuuagcuucggggcaucauguuucauacuucuagccauuguaaugggccuugucuucauauguguaaagaauggaaacaugcggugcacuauuuguauauaa

SEQ ID NO: 42328 - RNA, 1701 nt, Artificial Sequence
  hemagglutinin__InfluenzaA__AHM98309
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauucugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagguauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42329 - RNA, 1710 nt, Artificial Sequence
  hemagglutinin__InfluenzaA__AHM98339
augaaggcaauacuaguaguucugcuauauacauuugcaaccgcaaaugcagacacauuauguauagguuaucaugcgaacaauucaacagacacuguagacacaguacuagaaaagaauguaacaguaacacacucugucaaccuucuagaagacaagcauaacgggaaacuaugcaagcuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagaugcauauguuuuuguggggacaucaagauacagcaagaaguucaagccggaaauagcaauaagacccaaagugagagaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucaccagccucccauuucagaauauacauccgaucacaauuggaaaauguccaaaauauguaaaaagcacaaaauugagacuggccacaggauugaggaaugucccaucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaaaaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauuaguacugguagucucccugggggcaaucaguuucuggaugugcucuaaugggucucuacaguguagaauauguauuuaa

SEQ ID NO: 42330 - RNA, 1701 nt, Artificial Sequence
  hemagglutinin__InfluenzaA__AHM98350
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauucugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacgcgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 42331 - RNA, 1701 nt, Artificial Sequence
  hemagglutinin__InfluenzaA__AHM98361
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccguccauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 42332 - RNA, 1701 nt, Artificial Sequence
  hemagglutinin__InfluenzaA__AHM98372
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaacccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauuugaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42333 - RNA, 1701 nt, Artificial Sequence; identical to SEQ ID NO: 40275
  hemagglutinin__InfluenzaA__AHM98383

SEQ ID NO: 42334 - RNA, 1701 nt, Artificial Sequence
  hemagglutinin__InfluenzaA__AHM98394
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcuuguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauuugcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauccaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugcuaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 42335 - RNA, 1701 nt, Artificial Sequence
  hemagglutinin__InfluenzaA__AHM98405
augaaggcaauacuaguaguuuugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauuacauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuuaaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucgaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaucagauuuuggcgaucuauucaacugucgccaguucauugguacugguagucucccugggggcaaucaguuuuuggaugugcucuaaugggucucuacaguguagaauauguauuuaa

SEQ ID NO: 42336 - RNA, 1701 nt, Artificial Sequence
  hemagglutinin__InfluenzaA__AHM98416
augaaggcaauacuaguaguuuugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauuacauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuuaaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauuaagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucgaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 42337 - RNA, 1701 nt, Artificial Sequence
  hemagglutinin__InfluenzaA__AHM98427
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcuuguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauuugcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauccaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugcuaaggaaauuggaaauggcugcuuugaauuuuaccacaaaugcgacaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 42338 - RNA, 1701 nt, Artificial Sequence
  hemagglutinin__InfluenzaA__AHM98438
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacgacagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaccuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgggauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugugauaacacgugcauggaaagugucaaaaaugggacuuaugacuacccaaaauacucagaggaagcaaaauuaaacagagaagaaauagaugggguaaagcuggaaucaacaaugauuuaccagauuuuggcgaucuauucaacugucgccaguucauugguacugguagucucccugggggcaaucaguuucuggaugugcucuaaugggucucuacaguguagaauauguauuuga

SEQ ID NO: 42339 - RNA, 1701 nt, Artificial Sequence
  hemagglutinin__InfluenzaA__AHM98449
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaacacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccacaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaaaaugaauacacaguucacagcaguagguaaagaguucaaccaccuggaaaaaagaauagagaauuuaaauaaaaaaguugaugauggguuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacguguauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuuuuggaugugcucuaaugggucucuacaguguagaauauguauuuaa

SEQ ID NO: 42340 - RNA, 1701 nt, Artificial Sequence
  hemagglutinin__InfluenzaA__AHM98460
augaaggcaauacuaguaguuuugcuauguacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauuacauuugggaaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauuaagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucaaaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaacaguccacgauugcaauacaacuugucagacacccaagggugcuauaaacaccagccuaccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucgaaugugaagaacuuauaugaaaagguaagaaaccaauuaaaaaacaaugccaaggaaauuggaaauggcugcuuugaauuuuaccacaaaugcgauaacacgugcauggaaaguguuaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 42341 - RNA, 1701 nt, Artificial Sequence; identical to SEQ ID NO: 40282
  hemagglutinin__InfluenzaA__AHM98471

SEQ ID NO: 42342 - RNA, 1701 nt, Artificial Sequence
  hemagglutinin__InfluenzaA__AHM98482
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugacaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 42343 - RNA, 1701 nt, Artificial Sequence
  hemagglutinin__InfluenzaA__AHM98493
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacugagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaagagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaacgauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaguaagacccaaagugagggaucaagaagggagaaugaacuauuacuggacacuaguagagccgggagacaaaauaacauucgaagcaacugggaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauauccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42344 - RNA, 1701 nt, Artificial Sequence
  hemagglutinin__InfluenzaA__AHM98504
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgauuacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucaaaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42345 - RNA, 1701 nt, Artificial Sequence
  hemagglutinin__InfluenzaA__AHM98515
augaaggcaauacuaguaguuuugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauuacauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucgaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 42346 - RNA, 1701 nt, Artificial Sequence
  hemagglutinin__InfluenzaA__AHM98526
augaaggcaauacuaguaguucugcuacauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagaacaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaggggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggcuuauuuggggccauugccggcuucauugaagggggguggacagggaugguagauggaugguacgguuaucaccaucaaaaugagcaggggucaggauaugcagccgaccugaggagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugauucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 42347 - RNA, 1701 nt, Artificial Sequence
  hemagglutinin__InfluenzaA__AHM98537
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccuggggaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaaacucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 42348 - RNA, 1701 nt, Artificial Sequence
  hemagglutinin__InfluenzaA__AHM98548
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaagcuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccggucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42349 - RNA, 1701 nt, Artificial Sequence
  hemagglutinin__InfluenzaA__AHM98559
augaaggcaauacuaguaguucugcuauacacauuugcaaccgcaaaagcagacacauuauguauagguuaucaugcgaacaauucaacagacacuguagacacaguacuagaaaagaauguaacaguaacacacucuguuaaccuucuagaagacaagcauaacgggaaacuaugcaagcuaagagggguagccccauugcauuuggguaaauguaacauugcuggcuggaucuugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugccauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42350 - RNA, 1701 nt, Artificial Sequence; identical to SEQ ID NO: 42334
  hemagglutinin__InfluenzaA__AHM98570

SEQ ID NO: 42351 - RNA, 1701 nt, Artificial Sequence
  hemagglutinin__InfluenzaA__AHM98581
augaaggcaauacuaguaguuuugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauuacauuuggguaaauguaacauugcuggcuggauccugggaaauccagagugugaaucacucuccacagcaagaucaugguccuacauuguggaaacaucuaguucagacaauggaacguguuacccaggagauuucaucgauuaugaggagcuaagagagcaauugagcucagugucaucauuuaaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucgaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaucagauuuuggcgaucuauucaacugucgccaguucauugguacugguagucucccugggggcaaucaguuuuuggaugugcucuaaugggucucuacaguguagaauauguauuuaa

SEQ ID NO: 42352 - RNA, 1701 nt, Artificial Sequence; identical to SEQ ID NO: 42334
  hemagglutinin__InfluenzaA__AHM98592

SEQ ID NO: 42353 - RNA, 1701 nt, Artificial Sequence
  hemagglutinin__InfluenzaA__AHM98603
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggauggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugugauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42354 - RNA, 1701 nt, Artificial Sequence; identical to SEQ ID NO: 42345
  hemagglutinin__InfluenzaA__AHM98614

SEQ ID NO: 42355 - RNA, 1701 nt, Artificial Sequence; identical to SEQ ID NO: 42335
  hemagglutinin__InfluenzaA__AHM98625

SEQ ID NO: 42356 - RNA, 1701 nt, Artificial Sequence; identical to SEQ ID NO: 42335
  hemagglutinin__InfluenzaA__AHM98636

SEQ ID NO: 42357 - RNA, 1701 nt, Artificial Sequence
  hemagglutinin__InfluenzaA__AHM98647
augaaggcaauacuaguaguucugcuauacacauuugcaaccgcaaaagcagacacauuauguauagguuaucaugcgaacaauucaacagacacuguagacacaguacuagaaaagaauguaacaguaacacacucuguuaaccuucuagaagacaagcauaacgggaaacuaugcaagcuaagagggguagccccauugcauuuggguaaauguaacauugcuggcuggaucuugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugccauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42358 - RNA, 1701 nt, Artificial Sequence; identical to SEQ ID NO: 40275
  hemagglutinin__InfluenzaA__AHM98658

SEQ ID NO: 42359 - RNA, 1701 nt, Artificial Sequence; identical to SEQ ID NO: 42334
  hemagglutinin__InfluenzaA__AHM98669

SEQ ID NO: 42360 - RNA, 1701 nt, Artificial Sequence
  hemagglutinin__InfluenzaA__AHM98701
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaacacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagaaccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaaaaugaauacacaguucacagcaguagguaaagaguucaaccaccuggaaaaaagaauagagaauuuaaauaaaaaaguugaugauggguuucuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacguguauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuuuuggaugugcucuaaugggucucuacaguguagaauauguauuuaa

SEQ ID NO: 42361 - RNA, 1701 nt, Artificial Sequence
  hemagglutinin__InfluenzaA__AHM98712
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaacacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucaaaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaaaaugaauacacaguucacagcaguagguaaagaguucaaccaccuggaaaaaagaauagagaauuuaaauaaaaaaguugaugauggguuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacguguauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuuuuggaugugcucuaaugggucucuacaguguagaauauguauuuaa

SEQ ID NO: 42362 - RNA, 1701 nt, Artificial Sequence
  hemagglutinin__InfluenzaA__AHM98723
augaaggcaauacuaguaguucugcuauauacauuugcaaccgcaaaugcagacacauuauguauagguuaucaugcgaacaacucaacagacacuguagacacaguacuagaaaagaauguaacaguaacacacucuguuaaccuucuagaagacaagcauaacgggaaacuaugcaaacugagagggguagccccauugcauuuggguaauuguaacauugcuggcuggauccugggaaauccagagugugaaucacucuccacagcaagcucaugguccuacaucguggaaacaucuaguucagacaauggaacaugcuacccaggagauuucaucaauuaugaggagcuaagagagcaauugagcucagugucaucauuugaaagguuugagauacuccccaagacaaguucauggcccaaucaugacucgaacaaagguguaacggcagcauguccucaagcuggagcaaaaagcuucuacaaaaauuuaauauggcuaguuaaaaaaggaaauucauacccaaagcucagcaaauccuacauuaacgauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaguaagacccaaagugagggaucaagaagggagaaugaacuauuacuggacacuaauagagccgggagacaaaauaacauucgaagcaacuggaaaucuauugguaccaagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaaugucccaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugcgcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaagauacucagaggaagcaaaauuaaacagagaagaaauagaugggguaaagcuagaaucaacaaggauuuaccagauuuuggcgaucuauucaacugucgccaguucauugguacugauagucucccugggggcaaucaguuucuggaugugcucuaaugggucucuacaguguagaauauguauuuaa

SEQ ID NO: 42363 - RNA, 1701 nt, Artificial Sequence
  hemagglutinin__InfluenzaA__AHM98734
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaacacucuccacagcaagcucaugguccuacauuguggaaacaucuaauucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggaucaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaaaaugaauacacaguucacagcaguagguaaagaguucaaccaccuggaaaaaagaauagagaauuuaaauaaaaaaguugaugauggguuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacguguauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuuuuggaugugcucuaaugggucucuacaguguagaauauguauuuaa

SEQ ID NO: 42364 - RNA, 1701 nt, Artificial Sequence
  hemagglutinin__InfluenzaA__AHM98745
augaaggcaauacuaguaguucugcuauauacauuugcaaccgcaaaugcagacacauuauguauagguuaccaugcgaacaacucaacagacacuguagacacaguacuagaaaagaauguaacaguaacacacucuguuaaucuucuagaagacaagcauaacgggaaacuaugcaagcuaagaggaguagccccauugcauuuggguaaauguaacauugcuggcuggauccugggaaauccagagugugaaacacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcuuguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggauggacagggaugguagauggaugguacgguuaucaccaucaaaaugagcaggggucaggauaugcagccgaccugaagagcacacagaaugccauugacaagauuacuaacaaaguaaauucuguuauugaaaaaaugaauacacaguucacagcaguagguaaagaguucaaccaccuggaaaaaagaauagagaauuuaaauaaaaaaguugaugauggguuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacguguauggaaagugucaaaaaugggacuuaugacuacccaaaauacucagaggaagcaaaauuaaacagagaagaaauagaugggguaaagcuggaaucaacaaggauuuaccagauuuuggcgaucuauucaaccgccgccaguucauugguacugguagucucccugggggcaaucaguuuuuggaugugcucuaaugggucucuacaguguagaauauguauuuaa

SEQ ID NO: 42365 - RNA, 1701 nt, Artificial Sequence
  hemagglutinin__InfluenzaA__AHM98756
augaaggcaauacuaguaguucugcuauauacauuugcaaccgcaaaugcagacacauuauguauagguuaccaugcgaacaacucaacagacacuguagacacaguacuagaaaagaauguaacaguaacacacucuguuaaucuucuagaagacaagcauaacgggaaacuaugcaaacuaagaggaguagccccauugcauuuggguaaauguaacauugcuggcuggauccugggaaauccagagugugaaacacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaaggaguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucuuuaucagaaugcagauacauauguuuuuguggggacaucaagauacagcaagaaguucaagccggaaauagcaauaagacccaaagugagggaucaagaagggagaaugaacuauuacuggacauuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggauggacagggaugguagauggaugguacgguuaucaccaucaaaaugagcaggggucaggauaugcagccgaccugaagagcacacagaaugccauugacaagauuacuaacaaaguaaauucuguuauuguaaaaaugaauacacaguucacagcaguagguaaagaguucaaccaccuggaaaaaagaauagagaauuuaaauaaaaaaguugaugauggguuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacguguauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuuuuggaugugcucuaaugggucucuacaguguagaauauguauuuaa

SEQ ID NO: 42366 - RNA, 1701 nt, Artificial Sequence
  hemagglutinin__InfluenzaA__AHM98767
augaaggcaauacuaguaguucugcuauauacauuugcaaccgcaaaugcagacacauuauguauagguuaccaugcgaacaacucaacagacacuguagacacaguacuagaaaagaauguaacaguaacacacucuguuaaucuucuagaagacaagcauaacgggaaacuaugcaaacuaagaggaguagccccauugcauuuggguaaauguaacauugcuggcuggauccugggaaauccagagugugaaacacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggauggacagggaugguagauggaugguacgguuaucaccaccaaaaugagcaggggucaggauaugcagccgaccugaagagcacacagaaugccauugacaagauuacuaacaaaguaaauucuguuauugaaaaaaugaauacacaguucacagcaguagguaaagaguucaaccaccuggaaaaaagaauagagaauuuaaauaaaaaaguugaugauggguuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacguguauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuuuuggaugugcucuaaugggucucuacaguguagaauauguauuuaa

SEQ ID NO: 42367 - RNA, 1701 nt, Artificial Sequence
  hemagglutinin__InfluenzaA__AHM98778
augaaggcaauacuaguaguucugcuauauacauuugcaaccgcaaaugcagacacauuauguauagguuaucaugcgaacaauucaacagacacuguagacacaguauuagaaaagaauguaacaguaacucacucuguuaaccuucuagaagacaagcauaacaggaaacuaugcaaacuaagagggguugccccauugcauuuggguaaauguaacauugcgggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugaaauauuccccaagacaaguucauggcccaaucaugacucgaacaaagguguaacggcagcauguccucgugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggagccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauaugcauuuaa

SEQ ID NO: 42368 - RNA, 1701 nt, Artificial Sequence; identical to SEQ ID NO: 40321
  hemagglutinin__InfluenzaA__AHM98798

SEQ ID NO: 42369 - RNA, 1701 nt, Artificial Sequence
  hemagglutinin__InfluenzaA__AHM98809
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguggccccauugcauuugggaaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuucuuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 42370 - RNA, 1701 nt, Artificial Sequence; identical to SEQ ID NO: 37415
  hemagglutinin__InfluenzaA__AHM98820

SEQ ID NO: 42371 - RNA, 1701 nt, Artificial Sequence
  hemagglutinin__InfluenzaA__AHM98831
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaucauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaauuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 42372 - RNA, 1701 nt, Artificial Sequence
  hemagglutinin__InfluenzaA__AHM98836
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggauacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 42373 - RNA, 1701 nt, Artificial Sequence
  hemagglutinin__InfluenzaA__AHM98847
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcaugacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 42374 - RNA, 1701 nt, Artificial Sequence; identical to SEQ ID NO: 40332
  hemagglutinin__InfluenzaA__AHM98858

SEQ ID NO: 42375 - RNA, 1701 nt, Artificial Sequence
  hemagglutinin__InfluenzaA__AHM98877
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggauucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42376 - RNA, 1701 nt, Artificial Sequence
  hemagglutinin__InfluenzaA__AHM98898
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaaucauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggauucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagaucuuggcgaucuauucaacugucgccaguucauugguacugguagucucccugggggcaaucaguuucuggaugugcucuaaugggucucuacaguguagaauauguauuuaa

SEQ ID NO: 42377 - RNA, 1701 nt, Artificial Sequence; identical to SEQ ID NO: 40964
  hemagglutinin__InfluenzaA__AHM98909

SEQ ID NO: 42378 - RNA, 1701 nt, Artificial Sequence
  hemagglutinin__InfluenzaA__AHM98932
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaggagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggagauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucgagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42379 - RNA, 1701 nt, Artificial Sequence; identical to SEQ ID NO: 42378
  hemagglutinin__InfluenzaA__AHM98940

SEQ ID NO: 42380 - RNA, 1701 nt, Artificial Sequence; identical to SEQ ID NO: 42378
  hemagglutinin__InfluenzaA__AHM98951

SEQ ID NO: 42381 - RNA, 1701 nt, Artificial Sequence
  hemagglutinin__InfluenzaA__AHM98975
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugaaucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42382 - RNA, 1701 nt, Artificial Sequence
  hemagglutinin__InfluenzaA__AHM98997
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggagauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42383 - RNA, 1701 nt, Artificial Sequence
  hemagglutinin__InfluenzaA__AHM99019
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaaaagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggagauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42384 - RNA, 1701 nt, Artificial Sequence; identical to SEQ ID NO: 42383
  hemagglutinin__InfluenzaA__AHM99031

SEQ ID NO: 42385 - RNA, 1701 nt, Artificial Sequence; identical to SEQ ID NO: 42383
  hemagglutinin__InfluenzaA__AHM99043

SEQ ID NO: 42386 - RNA, 1701 nt, Artificial Sequence; identical to SEQ ID NO: 42383
  hemagglutinin__InfluenzaA__AHM99054

SEQ ID NO: 42387 - RNA, 1701 nt, Artificial Sequence; identical to SEQ ID NO: 42383
  hemagglutinin__InfluenzaA__AHM99065

SEQ ID NO: 42388 - RNA, 1701 nt, Artificial Sequence
  hemagglutinin__InfluenzaA__AHM99075
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggagauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42389 - RNA, 1701 nt, Artificial Sequence
  hemagglutinin__InfluenzaA__AHN00717
augaaggcaauacuauuagucuugcuauguacauuugcagccacaaaugcagacacacuauguauagguuaccaugcaaauaauucaacugacacuguugauacaguauuagaaaagaauguaacaguaacacacucuguuaaccuucuugaagacagacauaacggaaaacuauguaaacuaggggggauagccccauugcaccuggguaaauguaacauugccggauggcuuuugggaaauccagaaugugaauuacuauucacaguaagcucauggucuuacauuguggaaacaucgaacucagacaaugggacauguuacccaggggauuucaucaauuaugaagagcugagagagcaguugagcucagugucaucauuugaaagauucgagauauuccccaagacaaguucguggcccaaucaugaaacaaacagaggugugacggcagcaugcccuuaugcuggagcaaacagcuucuacagaaauuuaauauggcuggugaaaaaaggaaacucauauccaaagcucagcaaauccuauguuaacaauaaggggaaggaaguccuugugcuauggggcauccaccauccaccuaccaguacugaucaacaaagucucuaccagaaugcagaugccuauguuuuuguagggucaucaaaauauaacaggaaguucaagccagaaauagcagcaagacccaaggugagaggucaagcagggaggaugaacuauuacuggacacuaauagaaccuggagacacaauaacauucgaagcaacuggaaaucuagugguaccaagauaugcuuucgcaaugaauagagguccuggaucugguauuauaauuucggaugcaccaguucaugauuguaacacgacgugucaaacacccaagggugccauaaacaccagccucccauuucagaauauacauccagucacaauuggagaauguccaaaauaugucaaaagcacaaaauugagaauggcuacaggacuaaggaauaucccgucuauucaaucuagaggucuguuuggagccauugcugguuuuauugaggggggauggacaggaaugauagauggaugguaugguuaucaccaucagaaugaacagggaucaggauaugcagcggaccaaaaaagcacacagaaugccauugacgggaucacuaacaaaguaaauucuguuauuaaaaagaugaacacacaauucacagcaguggguaaagaauucaaccacuuggaaaaaagaauagagaauuuaaacaaaaagguugaugaugguuuucuggauguuuggacauacaaugccgaacuguugguucuauuggaaaaugaaagaacucuggauuuccacgacucgaauguaaagaaccuguaugagaaaguaagaagccaacuaaggaacaaugccaaggaaauugggaauggcugcuuugaauucuaucacaaaugugaugauacaugcauggagagcgucaaaaaugggacuuaugauuacccaaaguacucagaagaaucaaaacuaaacagagaggaaauagauggaguaaaguuggagucaacaaggauuuaccagauuuuggcgaucuauucaacugccgccaguucauugguacuguuggucucccugggggcaaucaguuucuggaugugcuccaaugggucuuuacagugcagaauauguauuuaa

SEQ ID NO: 42390 - RNA, 1701 nt, Artificial Sequence
  hemagglutinin__InfluenzaA__AHN00764
augaaggcaauacuauuagucuugcuauguacauuugcagccacaaaugcagacacacuauguauagguuaccaugcaaauaauucaacugacacuguugauacaguacuagaaaagaauguaacaguaacacacucuguuaaccuucuugaagacaaacauaacggaaaacuauguaaacuaggggggauagccccauugcaccuggguaaauguaacauugccggauggcuuuugggaaauccagaaugugaauuacuauucacaguaagcucauggucuuacauuguggaaacaucgaacucagacaaugggacauguuacccaggggauuucaucaauuaugaagagcugagagagcaguugagcucagugucaucauuugaaagauucgagauauuccccaagacaaguucguggcccaaucaugaaacaaacagaggugugacggcagcaugcccuuaugcuggagcaaacagcuucuacagaaauuuaauauggcuggugaaaaaaggaaacucauauccaaagcucagcaaauccuauguuaacaauaaggggaaggaaguccuugugcuauggggcauucaccauccaccuaccaguacugaucaacaaagucucuaccagaaugcagaugccuauguuuuuguagggucaucaaaauauaacaggaaguucaagccagaaauagcagcaagacccaaggugagaggucaagcagggaggaugaacuauuacuggacacuaauagaaccuggagacacaauaacauucgaagcaacuggaaaucuagugguaccaagauaugcuuucgcaaugaauagagguccuggaucugguauuauaauuucggaugcaccaguucaugauuguaacacgacgugucaaacacccaagggugccauaaacaccagccucccauuucagaauauacauccagucacaauuggagaauguccaaaauaugucaaaagcacaaaauugagaauggcuacaggacuaaggaauaucccaucuauucaaucuagaggucuguuuggagccauugcugguuuuauugaggggggauggacaggaaugauagauggaugguaugguuaucaccaucagaaugaacagggaucaggauaugcagcggaccaaaaaagcacacagaaugccauugacgggaucacuaacaaaguaaauucuguuauuaaaaagaugaacacacaauucacagcaguggguaaagaauucaaccacuuggaaaaaagaauagagaauuuaaacaaaaagguugaugaugguuuucuggauguuuggacauacaaugccgaacuguugguucuauuggaaaaugaaagaacucuggauuuccacgacucgaauguaaagaaccuguaugagaaaguaagaagccaacuaaggaacaaugccaaggaaauugggaauggcugcuuugaauucuaucacaaaugugaugauacaugcauggagagcgucaaaaaugggacuuaugauuacccaaaguacucagaagaaucaaaacuaaacagagaggaaauagauggaguaaaguuggagucaacaaggauuuaccagauuuuggcgaucuauucaacugccgccaguucauugguacuguuggucucccugggggcaaucaguuucuggaugugcuccaaugggucuuuacagugcagaauauguauuuaa

SEQ ID NO: 42391 - RNA, 1683 nt, Artificial Sequence
  hemagglutinin__InfluenzaA__AHN96323
augaacacucaaauccugguauucgcucugauugcgaucauuccaacaaaugcagacaaaaucugccucggacaucaugccgugucaaacggaaccaaaguaaacacauuaacugaaagaggaguggaagucgucaaugcaacugaaacaguggaacgaacaaacauccccaggaucugcucaaaagggaaaaggacaguugaccucggucaauguggacuccuggggacaaucacuggaccaccucaaugugaccaauuccuagaauuuucagccgauuuaauuauugagaggcgagaaggaagugaugucuguuauccugggaaauucgugaaugaagaagcucugaggcaaauucucagagaaucaggcggaauugacaaggaagcaaugggauucacauacaguggaauaagaacuaauggagcaaccagugcauguaggagaucaggaucuucauucuaugcagaaaugaaauggcuccugucaaacacagauaaugcugcauucccgcagaugacuaagucauauaaaaauacaagaaaaagcccagcucuaauaguaugggggauccaccauuccguaucaacugcagagcaaaccaagcuauaugggaguggaaacaaacuggugacaguugggaguucuaauuaucaacaaucuuuuguaccgaguccaggagcgagaccacaaguuaauggucuaucuggaagaauugacuuucauuggcuaaugcuaaaucccaaugauacagucacuuucaguuucaauggggcuuucauagcuccagaccgugcaagcuuccugagaggaaaaucuaugggaauccagaguggaguacagguugaugccaauugugaaggggacugcuaucauaguggagggacaauaauaaguaacuugccauuucagaacauagauagcagggcaguuggaaaauguccgagauauguuaagcaaaggagucugcugcuagcaacagggaugaagaauguuccugagaucccaaagggaagaggccuauuuggugcuauagcggguuucauugaaaauggaugggaaggccuaauugaugguugguaugguuucagacaccagaaugcacagggagagggaacugcugcagauuacaaaagcacucaaucggcaauugaucaaauaacaggaaaauuaaaccggcuuauagaaaaaaccaaccaacaauuugaguuaauagacaaugaauucaaugagguagagaagcaaaucgguaaugugauaaauuggaccagagauucuauaacagaaguguggucauacaaugcugaacucuugguagcaauggagaaccagcauacaauugaucuggcugauucagaaauggacaaacuguacgaacgagugaaaagacagcugagagagaaugcugaagaagauggcacugguugcuuugaaauauuucacaagugugaugaugacuguauggccaguauuagaaauaacaccuaugaucacagcaaauacagggaagaggcaaugcaaaauagaauacagauugacccagucaaacuaagcagcggcuacaaagaugugauacuuugguuuagcuucggggcaucauguuucauacuucuagccauuguaaugggccuugucuucauauguguaaagaauggaaacaugcggugcacuauugguauauaa

SEQ ID NO: 42392 - RNA, 1701 nt, Artificial Sequence
  hemagglutinin__InfluenzaA__AHN96442
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaacuaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42393 - RNA, 1701 nt, Artificial Sequence
  hemagglutinin__InfluenzaA__AHN96443
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaagucacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuauaccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaguacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaacgggaagcugaauagauugaucgggaaaaccaacgagaaauuccaucagauugaaaaagaauucucagaagucgaagggagaauucaggaccuugagaaauauguugaggacacuaaaauagaucucuggucauacaaugcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42394 - RNA, 1701 nt, Artificial Sequence
  hemagglutinin__InfluenzaA__AHN96444
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacuuaaacuucaaauacccagcauugaacgugacuaugccaaacaaucaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauucggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagagaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaauugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42395 - RNA, 1701 nt, Artificial Sequence
  hemagglutinin__InfluenzaA__AHN96445
augaagacuaucauugcuuugagcuacauucuaugucugguuuucgcccaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacuuaaacuucaaauacccagcauugaacgugacuaugccaaacaaucaacaauuugacaaauuauacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacuaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauauggguaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42396 - RNA, 1701 nt, Artificial Sequence
  hemagglutinin__InfluenzaA__AHN96447
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaagggggucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguuguuuuguugggguucaucaugugggccugccaaaagggcaacauuaggugcaacauuugcauuuga

SEQ ID NO: 42397 - RNA, 1701 nt, Artificial Sequence
  hemagglutinin__InfluenzaA__AHV83765
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaccaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42398 - RNA, 1701 nt, Artificial Sequence
  hemagglutinin__InfluenzaA__AHV83766
augaaggcaauacuaguaguucugcuauauacauuugcaaccacaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccgguuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaacgccgaacuguugguucuauuggaaaaugaaagaacuuuggacuaccacgauucaaaugugaagaacuuguaugaaaagguaagaaaccaguuaaaaaacaaugcaaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42399 - RNA, 1701 nt, Artificial Sequence; identical to SEQ ID NO: 41497
  hemagglutinin__InfluenzaA__AHV83767

SEQ ID NO: 42400 - RNA, 1701 nt, Artificial Sequence
  hemagglutinin__InfluenzaA__AHV83768
augaaggcaauacuaguaguucugcuauauacauuuacaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuauuagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaauacgugcauggacagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccuaggggcaaucagcuucuggaugugcucuaaugggucucuacaguguagaauauguauuuaa

SEQ ID NO: 42401 - RNA, 1701 nt, Artificial Sequence
  hemagglutinin__InfluenzaA__AHV83770
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaauucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauauucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42402 - RNA, 1701 nt, Artificial Sequence
  hemagglutinin__InfluenzaA__AHV83771
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacuacugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaaugcccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccagaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42403 - RNA, 1701 nt, Artificial Sequence
  hemagglutinin__InfluenzaA__AHV83772
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaaacuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42404 - RNA, 1701 nt, Artificial Sequence; identical to SEQ ID NO: 41494
  hemagglutinin__InfluenzaA__AHV83773

SEQ ID NO: 42405 - RNA, 1701 nt, Artificial Sequence
  hemagglutinin__InfluenzaA__AHV83774
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuucguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42406 - RNA, 1701 nt, Artificial Sequence
  hemagglutinin__InfluenzaA__AHV83775
augaaggcaauacuaguaguucugcuauauacauuugcaaccgcaaaugcagacacuuuauguauagguuaucaugcgaacaauucaacagacacuguagacacaguacuagaaaagaauguaacaguaacacacucuguuaaccuucuagaagacaagcauaacgguaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagucaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaacauacauccgaucacaauuggaaaauguccaaaguauguaaaaagcacaaaauugagacuggcaacaggauugaggaauaucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaauaaaguaaacucuguuauugaaaagaugaauacacaguucacagcaguggguaaagaguucaaccaccuggaaaaaagaauugagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42407 - RNA, 1701 nt, Artificial Sequence
  hemagglutinin__InfluenzaA__AHV83776
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaaugcccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaauucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42408 - RNA, 1701 nt, Artificial Sequence
  hemagglutinin__InfluenzaA__AHV83777
augaaggcaauacuaguaguucugcuauauacauuugcaaccgcaaaugcagacacuuuauguauagguuaucaugcgaacaauucaacagacacuguagacacaguacuagaaaagaauguaacaguaacacacucuguuaaccuucuagaagacaagcauaacgguaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagucaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggcaacaggauugaggaauaucccgucuauucaaucuagaggccuauucggggccauugccggcuucauugaagggggguggacagggaugguagauggaugguacgguuaucaccaucaaaaugagcaggggucaggauaugcagccgaccugaaaagcacacaaaaugccauugacaagauuacuaacaaaguaaacucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucugcuucuggaugugcucuaaugggucucuacaguguagaauauguauuuaa

SEQ ID NO: 42409 - RNA, 1701 nt, Artificial Sequence
  hemagglutinin__InfluenzaA__AHV83778
augaaggcaauacuaguaguucugcuauauacauuuacaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccuugugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccagucuacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauugaacagagaaaaaauagaugggguaaagcuggaaucaacaaggauuuaccagauuuuggcgaucuauucaacugucgccaguucguugguacugguagucucccugggggcaaucagcuucuggaugugcucuaaugggucucuacaguguagaauauguauuuaa

SEQ ID NO: 42410 - RNA, 1701 nt, Artificial Sequence
  hemagglutinin__InfluenzaA__AHV83779
augaaggcaauacuaguaguucugcuauauacauuugcaaccacaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccgucuacuacugcugaucaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacgaaauugagacuggccacaggauuaaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugcaaaggaaacuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42411 - RNA, 1701 nt, Artificial Sequence
  hemagglutinin__InfluenzaA__AHV83780
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcuccgccaauccuacauuaaugauaaagggaaagaaguccucgugcuguggggcauucaccacccaucuacuacuacugaccaacaaagucucuaucagaaugcagaugcauauguuuuugugggaacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42412 - RNA, 1701 nt, Artificial Sequence
  hemagglutinin__InfluenzaA__AHV83781
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccuaaauacucagaggaagcaaaauuaaacagagaaaaaauagaugggguaaaacuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42413 - RNA, 1701 nt, Artificial Sequence
  hemagglutinin__InfluenzaA__AHV83782
augaaggcaauacuaguaguucugcuauauacacuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacggcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuaguggcaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaaacuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42414 - RNA, 1701 nt, Artificial Sequence
  hemagglutinin__InfluenzaA__AHV83783
augaaggcaauacuaguaguucugcuauauacauuugcaaccgcaaaugcagacacauuauguauagguuaucaugcgaacaauucaacagacacuguagacacaguacuagaaaagaauauaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaggcuucuacaaaaauuuaauauggcuaguuaaaaaaggaaauucauacccaaagcuccgccaauccuacauuaaugauaaagggaaagaaguccucgugcuguggggcauucaccacccaucuacuacuacugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42415 - RNA, 1701 nt, Artificial Sequence
  hemagglutinin__InfluenzaA__AHV83784
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugagaaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguuuaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaggcaaaauuaaacagagaaaaaauagaugggguaaaacuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42416 - RNA, 1701 nt, Artificial Sequence
  hemagglutinin__InfluenzaA__AHV83785
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcaaucuauucaacugucgccaguucauugguacugguagucucccugggggcaaucagcuucuggaugugcucuaaugggucucuacaguguagaauauguauuuaa

SEQ ID NO: 42417 - RNA, 1701 nt, Artificial Sequence; identical to SEQ ID NO: 42405
  hemagglutinin__InfluenzaA__AHV83787

SEQ ID NO: 42418 - RNA, 1701 nt, Artificial Sequence
  hemagglutinin__InfluenzaA__AHV83788
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguauccccauugcauuuggguaaauguaacauugcuggcuggauccugggaaacccagagugugaaucacucuccacagcaaguucaugguccuacauuguggaaacaucuaguucagacaauggaacguguuacccaggagauuucgucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguaugguuaucaccaucaaaaugagcaggggucaggauaugcagccgaccuaaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaucacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42419 - RNA, 1701 nt, Artificial Sequence
  hemagglutinin__InfluenzaA__AHV83789
augaaggcaauacuaguaguucugcuauauacauuugcaaccgcaaaugcagacacuuuauguauagguuaucaugcgaacaauucaacagacacuguagacacaguacuagaaaagaauguaacaguaacacacucuguuaaccuucuagaagacaagcauaacgguaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagucaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggcaacaggauugaggaauaucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaacucuguuauugaaaagaugaauacacaguucacagcgguggguaaagaguucaaccaccuggaaaaaagaauugagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42420 - RNA, 1701 nt, Artificial Sequence
  hemagglutinin__InfluenzaA__AHV83790
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaauucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42421 - RNA, 1701 nt, Artificial Sequence; identical to SEQ ID NO: 41526
  hemagglutinin__InfluenzaA__AHV83791

SEQ ID NO: 42422 - RNA, 1701 nt, Artificial Sequence; identical to SEQ ID NO: 41526
  hemagglutinin__InfluenzaA__AHV83792

SEQ ID NO: 42423 - RNA, 1701 nt, Artificial Sequence
  hemagglutinin__InfluenzaA__AHV83793
augaaggcaauacuaguaguucugcuauauacauuugcaaccgcaaaugcagacacauuauguauagguuaucaugcgaauaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaaaguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaaucauacauuaaugauaaagggaaagaaauccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugagaaaugucccgucuauucaaucuagaggccuauucggggccauugccgguuucauugaagggggguggacagggaugguagauggaugguacgguuaucaccaucaaaaugagcaggggucaggauaugcagccgaccagaagagcacacaaaaugccauugacaagauuacuaacaaaguaaacucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42424 - RNA, 1701 nt, Artificial Sequence
  hemagglutinin__InfluenzaA__AHV83794
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccagaagagcacacaaaaugccauugacaagauuacuaacaaaguaaacucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42425 - RNA, 1701 nt, Artificial Sequence
  hemagglutinin__InfluenzaA__AHV83795
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagaggggucgccccauugcauuuggguaaauguaacauugcuggcuggauccugggaaauccagagugugaaucacucuccgcagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccagaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaagauuuaccagauuuuggcgaucuauucaacugucgccaguucauugguacugguagucucccugggggcaaucagcuucuggaugugcucuaaugggucucuacaguguagaauauguauuuaa

SEQ ID NO: 42426 - RNA, 1701 nt, Artificial Sequence
  hemagglutinin__InfluenzaA__AHV83796
augaaggcaauacuaguaguucugcuauauacauucgcaaccgcaaaugcagacacauuauguauagguuaucaugcaaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccagaagagcacacaaaaugccauugacaagauuacuaacaaaguaaacucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42427 - RNA, 1701 nt, Artificial Sequence; identical to SEQ ID NO: 41512
  hemagglutinin__InfluenzaA__AHV83798

SEQ ID NO: 42428 - RNA, 1701 nt, Artificial Sequence; identical to SEQ ID NO: 42403
  hemagglutinin__InfluenzaA__AHV83799

SEQ ID NO: 42429 - RNA, 1701 nt, Artificial Sequence
  hemagglutinin__InfluenzaA__AHV83800
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguugggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaaaaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42430 - RNA, 1701 nt, Artificial Sequence
  hemagglutinin__InfluenzaA__AHV83801
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagaggggucgccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccagaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaagauuuaccagauuuuggcgaucuauucaacugucgccaguucauugguacugguagucucccugggggcaaucagcuucuggaugugcucuaaugggucucuacaguguagaauauguauuuaa

SEQ ID NO: 42431 - RNA, 1701 nt, Artificial Sequence
  hemagglutinin__InfluenzaA__AHV83802
augaaggcaauacuaguaguucugcuauauacauuugcaaccgcaaaugcagacacauuauguauagguuaucaugcaaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaggucucuaucagaauguagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauugggaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42432 - RNA, 1701 nt, Artificial Sequence
  hemagglutinin__InfluenzaA__AHV83803
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacgacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42433 - RNA, 1701 nt, Artificial Sequence; identical to SEQ ID NO: 41497
  hemagglutinin__InfluenzaA__AHV83804

SEQ ID NO: 42434 - RNA, 1701 nt, Artificial Sequence
  hemagglutinin__InfluenzaA__AHV83805
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcagugggcaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42435 - RNA, 1701 nt, Artificial Sequence; identical to SEQ ID NO: 42424
  hemagglutinin__InfluenzaA__AHV83806

SEQ ID NO: 42436 - RNA, 1701 nt, Artificial Sequence
  hemagglutinin__InfluenzaA__AHV83807
augaaggcaauacuaguaguucugcuauacacauuugcaaccgcaaaugcagacacauuauguauagguuaucaugcgaacaauucaacagacacuguagacacaguacuagaaaaggauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagacacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42437 - RNA, 1701 nt, Artificial Sequence
  hemagglutinin__InfluenzaA__AHV83808
augaaggcaauacuaguaguucugcuauauacauuugcaaccgcaaaugcagacacauuauguauagguuaucaugcaaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaaaacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaagcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaacucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccaugauucaaaugugaagaacuuguaugaaaagguaagaaaccaguuaaaaaacaaugccaaggaaauuggaaacggcugcuuugaauuuuaccacaaaugcgauaacaugugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauuggugcugguagucucccugggggcaaucagcuucuggaugugcucuaaugggucucuacaguguagaauauguauuuaa

SEQ ID NO: 42438 - RNA, 1701 nt, Artificial Sequence
  hemagglutinin__InfluenzaA__AHV83809
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuauuauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacuaguagucucccugggggcaaucagcuucuggaugugcucuaaugggucucuacaguguagaauauguauuuaa

SEQ ID NO: 42439 - RNA, 1701 nt, Artificial Sequence
  hemagglutinin__InfluenzaA__AHV83810
augaaggcaauacuaguaguucugcuauauacauuugcaaccacaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguaucaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugcaaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42440 - RNA, 1701 nt, Artificial Sequence
  hemagglutinin__InfluenzaA__AHV83812
augaaggcaauacuaguaguucugcuauauacauuuacaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuucccaagacaaguucauggcccaaucaugacucgaacaaagguguaacggcagcauguccucacgcuggagcaaaaagcuucuacaaaaauuuaauauggcuaguuaaaaaagggaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuauuauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugaauacccaaaauacucagaggaagcaaaauuaaacagagaaaaaauagaugguguaaagcuggaaucaacaaagauuuaccagauuuuggcgaucuauucaacugucgccaguucauugguacugguagucucccugggggcaaucagcuucuggaugugcucuaaugggucucuacaguguagaauauguauuuaa

SEQ ID NO: 42441 - RNA, 1701 nt, Artificial Sequence
  hemagglutinin__InfluenzaA__AHV83813
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacaccagagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaacgagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccgaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42442 - RNA, 1701 nt, Artificial Sequence
  hemagglutinin__InfluenzaA__AHV83814
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaaauuuggacuaccacgauucaaaugugaagaacuuguaugaaaagguaagaaaccaguuaaaaaccaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42443 - RNA, 1701 nt, Artificial Sequence
  hemagglutinin__InfluenzaA__AHV83815
augaaggcaauacuaguaguucugcuauauacauuugcaaccacaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugcaaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccaaauuuuggcgaucuauucaacugucgccaguucauugguacugguagucucccugggggcaaucagcuucuggaugugcucuaaugggucucuacaguguagaauauguauuuaa

SEQ ID NO: 42444 - RNA, 1701 nt, Artificial Sequence
  hemagglutinin__InfluenzaA__AHV83816
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaguaguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42445 - RNA, 1701 nt, Artificial Sequence
  hemagglutinin__InfluenzaA__AHV83817
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaguauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccaggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42446 - RNA, 1701 nt, Artificial Sequence
  hemagglutinin__InfluenzaA__AHV83818
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaccaccaucaaaaugagcaggggucaggauaugcagccgaccagaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42447 - RNA, 1701 nt, Artificial Sequence
  hemagglutinin__InfluenzaA__AHV83819
augaaggcaauacuaguaguucugcuauauacauuugcaaccgcaaaugcagacacuuuauguauagguuaucaugcgaacaauucaacagacacuguagacacaguacuagaaaagaauguaacaguaacacacucuguuaaccuucuagaagacaagcauaacgguaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagucaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguaugugaaaagcacaaaauugagacuggcaacaggauugaggaauaucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaacucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42448 - RNA, 1701 nt, Artificial Sequence
  hemagglutinin__InfluenzaA__AHV83821
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguauccccauugcauuuggguaaauguaacauugcuggcuggauccugggaaauccagagugugaaucacucuccacagcaaguucaugguccuacauuguggaaacaucuaguucagacaauggaacguguuacccaggagauuucgucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacaauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaucacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42449 - RNA, 1701 nt, Artificial Sequence
  hemagglutinin__InfluenzaA__AHV83822
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguauccccauugcauuuggguaaauguaacauugcuggcuggauccugggaaauccagagugugaaucacucuccacagcaaguucaugguccuacauuguggaaacaucuaguucagacaauggaacguguuacccaggagauuucgucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcugccgaccugaagagcacacaaaaugccauugacaagauuacuaacaaaguaaauucuauuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaucacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42450 - RNA, 1701 nt, Artificial Sequence
  hemagglutinin__InfluenzaA__AHV83823
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagaucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucacaauggaaagaaauacuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaggcaaaauuaaacagagaaaaaauagaugggguaaaacuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42451 - RNA, 1701 nt, Artificial Sequence
  hemagglutinin__InfluenzaA__AHV83824
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcuccgccaauccuacauuaaugauaaagggaaagaaguccucgugcuguggggcauucaccacccaucuacuacuacugaccaacaaagucucuaucagaaugcagaugcauauguuuuuguggggacaucaagauacagcaagaaguucaagccggaaauagcaauaagacccaaagugagagaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaaauuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42452 - RNA, 1701 nt, Artificial Sequence
  hemagglutinin__InfluenzaA__AHV83825
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccagaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42453 - RNA, 1701 nt, Artificial Sequence
  hemagglutinin__InfluenzaA__AHV83826
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacuuuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaacgagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugccgccaguucauugguacugguagucucccugggggcaaucagcuucuggaugugcucuaaugggucucuacaguguagaauauguauuuaa

SEQ ID NO: 42454 - RNA, 1701 nt, Artificial Sequence
  hemagglutinin__InfluenzaA__AHV83827
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacauccaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuaccacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaacgagcaggggucaggauaugcagccgaccugaagagcacacaaaaugccauugacaagauuacuaacaaaguaaauucuguuauugaaaagaugaauacgcaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaaacuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42455 - RNA, 1701 nt, Artificial Sequence
  hemagglutinin__InfluenzaA__AHV83828
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccugaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucuuugguacugguagucucccugggggcaaucagcuucuggaugugcucuaaugggucucuacaguguagaauauguauuuaa

SEQ ID NO: 42456 - RNA, 1701 nt, Artificial Sequence
  hemagglutinin__InfluenzaA__AHV83829
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagaucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaggcaaaauuaaacagagaaaaaauagaugggguaaaacuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42457 - RNA, 1701 nt, Artificial Sequence
  hemagglutinin__InfluenzaA__AHV83830
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaucugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaggcaaaauuaaacagagaaaaaauagaugggguaaaacuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42458 - RNA, 1701 nt, Artificial Sequence
  hemagglutinin__InfluenzaA__AHV83831
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacugagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuauugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucacaauggaaagaaaugcuggaucugguauuaucguuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccuaaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaaacuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42459 - RNA, 1701 nt, Artificial Sequence
  hemagglutinin__InfluenzaA__AHV83832
augaaggcaauacuaguaguucugcuauauacacuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacggcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuucuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaaacuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42460 - RNA, 1701 nt, Artificial Sequence
  hemagglutinin__InfluenzaA__AHV83833
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucgaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42461 - RNA, 1701 nt, Artificial Sequence; identical to SEQ ID NO: 41525
  hemagglutinin__InfluenzaA__AHV83834

SEQ ID NO: 42462 - RNA, 1701 nt, Artificial Sequence
  hemagglutinin__InfluenzaA__AHV83836
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaagaaaauucauacccaaagcuccgccaauccuacauuaaugauaaagggaaagaaguccucgugcuguggggcauucaccacccaucuacuacuacugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42463 - RNA, 1701 nt, Artificial Sequence
  hemagglutinin__InfluenzaA__AHV83837
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcuccgccaauccuacauuaaugauaaagggaaagaaguccucgugcuguggggcauucaccacccaucuacuacuacugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42464 - RNA, 1701 nt, Artificial Sequence
  hemagglutinin__InfluenzaA__AHV83838
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggcaauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaggcaaaauuaaacagagaaaaaauagaugggguaaaacuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42465 - RNA, 1701 nt, Artificial Sequence
  hemagglutinin__InfluenzaA__AHV83839
augaaggcaauacuaguaguucugcuauauacacuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacggcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucacgacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccuuaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaaacuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42466 - RNA, 1701 nt, Artificial Sequence; identical to SEQ ID NO: 42439
  hemagglutinin__InfluenzaA__AHV83840

SEQ ID NO: 42467 - RNA, 1701 nt, Artificial Sequence
  hemagglutinin__InfluenzaA__AHV83841
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcuccgccaauccuacauuaaugauaaagggaaagaaguccucgugcuguggggcauucaccacccaucuacuacuacugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacaauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42468 - RNA, 1701 nt, Artificial Sequence; identical to SEQ ID NO: 42457
  hemagglutinin__InfluenzaA__AHV83842

SEQ ID NO: 42469 - RNA, 1701 nt, Artificial Sequence; identical to SEQ ID NO: 42457
  hemagglutinin__InfluenzaA__AHV83843

SEQ ID NO: 42470 - RNA, 1701 nt, Artificial Sequence; identical to SEQ ID NO: 42444
  hemagglutinin__InfluenzaA__AHV83844

SEQ ID NO: 42471 - RNA, 1701 nt, Artificial Sequence
  hemagglutinin__InfluenzaA__AHV83845
augaaggcaauacuaguaguucugcuauauacauuugcaaccgcaaaugcagacacauuauguauagguuaucaugcaaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaaaacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaccuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaacucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugccgccaguucauugguacugguagucucccugggggcaaucagcuucuggaugugcucuaaugggucucuacaguguagaauauguauuuaa

SEQ ID NO: 42472 - RNA, 1701 nt, Artificial Sequence; identical to SEQ ID NO: 42405
  hemagglutinin__InfluenzaA__AHV83846

SEQ ID NO: 42473 - RNA, 1701 nt, Artificial Sequence
  hemagglutinin__InfluenzaA__AHV83847
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauuaguacugguagucucccugggggcaaucagcuucuggaugugcucuaaugggucucuacaguguagaauauguauuuaa

SEQ ID NO: 42474 - RNA, 1701 nt, Artificial Sequence
  hemagglutinin__InfluenzaA__AHV83848
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccguccauucaaucuagaggccuauucggggccauugccggcuucauugaaggaggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42475 - RNA, 1701 nt, Artificial Sequence
  hemagglutinin__InfluenzaA__AHV83849
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuguaugaaaagguaagaaaccaguuaaaaaccaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42476 - RNA, 1701 nt, Artificial Sequence
  hemagglutinin__InfluenzaA__AHV83850
augaaggcaauacuaguaguucugcuauauacauuugcaaccacaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccaaagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguaucaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugcaaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42477 - RNA, 1701 nt, Artificial Sequence
  hemagglutinin__InfluenzaA__AHV83851
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagagguccucgugcuguggggcauccaccauccaucuacuacugcugaccaacaaagucucuaucagaaugcagaugcauauguuuuuguggggacaucaagauacagcaaaaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacuauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccaucgacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaauguagaauauguauuuaa

SEQ ID NO: 42478 - RNA, 1701 nt, Artificial Sequence; identical to SEQ ID NO: 41518
  hemagglutinin__InfluenzaA__AHV83852

SEQ ID NO: 42479 - RNA, 1701 nt, Artificial Sequence
  hemagglutinin__InfluenzaA__AHV83853
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaacacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaaaaugaauacacaguucacagcaguagguaaagaguucaaccaccuggaaaaaagaauagagaauuuaaauaaaaaaguugaugauggguuccuggacauuuggacuuacaaugccgaacuguugguucuauuggaaaaugaaagaacuuuggacuaccacgauucaaaugugaagaacuuauaugaaaagguaagaacccaguuaaaaaacaaugccaaggaaauuggaaauggcugcuuugaauuuuaccacaaaugcgauaacacguguauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuuuuggaugugcucuaaugggucucuacaguguagaauauguauuuaa

SEQ ID NO: 42480 - RNA, 1701 nt, Artificial Sequence
  hemagglutinin__InfluenzaA__AHV83855
augaaggcaauacuaguaguccugcuauauacauuugcaaccgcaaaugcagacacuuuauguauagguuaucaugcgaacaauucaacagacacuguagacacaguacuagaaaagaauguaacaguaacacacucuguuaaccuucuagaagacaagcauaacgguaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagucaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccaggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggcaacaggauugaggaauaucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaacucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42481 - RNA, 1701 nt, Artificial Sequence
  hemagglutinin__InfluenzaA__AHV83856
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacuuuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaacucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaauugucaaaaaugggacuuaugacuacccaaaauacucagaggaagcaaaauuaaauagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42482 - RNA, 1701 nt, Artificial Sequence
  hemagglutinin__InfluenzaA__AHV83857
augaaggcaauacuaguaguucugcuauauacauuugcaaccgcaaaugcagacacuuuauguauagguuaucaugcgaacaauucaacagacacuguagacacaguacuagaaaagaauguaacaguaacacacucuguuaaccuucuagaagacaagcauaacgguaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagucaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggcaacaggauugaggaauaucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaacucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42483 - RNA, 1701 nt, Artificial Sequence
  hemagglutinin__InfluenzaA__AHV83858
augaaggcaauacuaguaguucugcuauauacauuugcaaccgcaaauacagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccagaagagcacacaaaaugccauugacaagauuacuaacaaaguaaacucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42484 - RNA, 1701 nt, Artificial Sequence; identical to SEQ ID NO: 41526
  hemagglutinin__InfluenzaA__AHV83859

SEQ ID NO: 42485 - RNA, 1701 nt, Artificial Sequence
  hemagglutinin__InfluenzaA__AHV83861
augaaggcaauacuaguaguucugcuauauacauuuacaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucgcucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42486 - RNA, 1701 nt, Artificial Sequence; identical to SEQ ID NO: 42485
  hemagglutinin__InfluenzaA__AHV83862

SEQ ID NO: 42487 - RNA, 1701 nt, Artificial Sequence; identical to SEQ ID NO: 42405
  hemagglutinin__InfluenzaA__AHV83863

SEQ ID NO: 42488 - RNA, 1701 nt, Artificial Sequence
  hemagglutinin__InfluenzaA__AHV83864
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaacgagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucugaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42489 - RNA, 1701 nt, Artificial Sequence
  hemagglutinin__InfluenzaA__AHV83866
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguggccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaauccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauacgcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgaugacacgugcauggaaagugucaaaaaugggacuuaugacuacccaaaauacucagaagaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42490 - RNA, 1701 nt, Artificial Sequence
  hemagglutinin__InfluenzaA__AHV83867
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguggccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauacgcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgaugacacgugcauggaaagugucaaaaaugggacuuaugacuacccaaaauacucagaagaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42491 - RNA, 1701 nt, Artificial Sequence
  hemagglutinin__InfluenzaA__AHV83868
augaaggcaauacuaguaguucugcuauauacauuugcaaccgcaaaugcagacacauuauguauagguuaucaugcgaacaauucgacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaacgagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42492 - RNA, 1701 nt, Artificial Sequence
  hemagglutinin__InfluenzaA__AHV83869
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaauucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggcuauugccggcuucauugaaggaggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaauguagaauauguauuuaa

SEQ ID NO: 42493 - RNA, 1701 nt, Artificial Sequence
  hemagglutinin__InfluenzaA__AHV83870
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuauauuguggaaacaucuaguucagacaauggaacguguuacccaggagauuucaucaauuaugaggagcuaagagagcaauugagcucaguaucaucauuugaaagguuugagauauuccccaagacaaguucauggcccaaucaugacucgaacaaagguguaacagcagcauguccucacgcuggagcaaaaagcuucuacaaaaauuuaauauggcuagucaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42494 - RNA, 1701 nt, Artificial Sequence; identical to SEQ ID NO: 42493
  hemagglutinin__InfluenzaA__AHV83871

SEQ ID NO: 42495 - RNA, 1701 nt, Artificial Sequence
  hemagglutinin__InfluenzaA__AHV83872
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaacgagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42496 - RNA, 1701 nt, Artificial Sequence
  hemagglutinin__InfluenzaA__AHV83873
augaaggcaauacuaguaguucugcuauauacauuugcaaccacaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccuugugcuguggggcauucaccauccaucuacuguugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugcaaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42497 - RNA, 1701 nt, Artificial Sequence
  hemagglutinin__InfluenzaA__AHV83874
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucaguaucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42498 - RNA, 1701 nt, Artificial Sequence; identical to SEQ ID NO: 42405
  hemagglutinin__InfluenzaA__AHV83875

SEQ ID NO: 42499 - RNA, 1701 nt, Artificial Sequence; identical to SEQ ID NO: 41497
  hemagglutinin__InfluenzaA__AHV83876

SEQ ID NO: 42500 - RNA, 1701 nt, Artificial Sequence
  hemagglutinin__InfluenzaA__AHV83877
augaaggcaauacuaguaguucugcuauauacauuugcaaccgcaaaugcagacacauuauguauagguuaucaugcgaacaauucaacagacacuguagacacaguacuagaaaagaauguaacaguaacacacuccguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauuaagcucagugucaucauuuaaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42501 - RNA, 1701 nt, Artificial Sequence
  hemagglutinin__InfluenzaA__AHV83878
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcuccgccaauccuacauuaaugacaaagggaaagaaguccucgugcuguggggcauucaccacccaucuacuacuacugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42502 - RNA, 1701 nt, Artificial Sequence; identical to SEQ ID NO: 42501
  hemagglutinin__InfluenzaA__AHV83879

SEQ ID NO: 42503 - RNA, 1701 nt, Artificial Sequence
  hemagglutinin__InfluenzaA__AHV83881
augaaggcaacacuaguaguucugcuauauacauuugccaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaacucuguuauugaaaagaugaauacacaguucacagcaguggguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42504 - RNA, 1701 nt, Artificial Sequence; identical to SEQ ID NO: 41525
  hemagglutinin__InfluenzaA__AHV83882

SEQ ID NO: 42505 - RNA, 1701 nt, Artificial Sequence; identical to SEQ ID NO: 41507
  hemagglutinin__InfluenzaA__AHV83883

SEQ ID NO: 42506 - RNA, 1701 nt, Artificial Sequence; identical to SEQ ID NO: 41494
  hemagglutinin__InfluenzaA__AHV83884

SEQ ID NO: 42507 - RNA, 1701 nt, Artificial Sequence
  hemagglutinin__InfluenzaA__AHV83885
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccugagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccagucuacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaacgagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42508 - RNA, 1701 nt, Artificial Sequence; identical to SEQ ID NO: 42424
  hemagglutinin__InfluenzaA__AHV83887

SEQ ID NO: 42509 - RNA, 1701 nt, Artificial Sequence; identical to SEQ ID NO: 41494
  hemagglutinin__InfluenzaA__AHV83888

SEQ ID NO: 42510 - RNA, 1701 nt, Artificial Sequence
  hemagglutinin__InfluenzaA__AHV83889
augaaggcaauacuaguaguucugcuacauacacuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacggcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaaacuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42511 - RNA, 1701 nt, Artificial Sequence; identical to SEQ ID NO: 41524
  hemagglutinin__InfluenzaA__AHV83890

SEQ ID NO: 42512 - RNA, 1701 nt, Artificial Sequence
  hemagglutinin__InfluenzaA__AHV83891
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccaagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42513 - RNA, 1701 nt, Artificial Sequence
  hemagglutinin__InfluenzaA__AHV83893
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccaagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaagggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42514 - RNA, 1701 nt, Artificial Sequence; identical to SEQ ID NO: 42512
  hemagglutinin__InfluenzaA__AHV83894

SEQ ID NO: 42515 - RNA, 1701 nt, Artificial Sequence
  hemagglutinin__InfluenzaA__AHV83895
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccaagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaaacaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42516 - RNA, 1701 nt, Artificial Sequence; identical to SEQ ID NO: 42512
  hemagglutinin__InfluenzaA__AHV83896

SEQ ID NO: 42517 - RNA, 1701 nt, Artificial Sequence; identical to SEQ ID NO: 42512
  hemagglutinin__InfluenzaA__AHV83897

SEQ ID NO: 42518 - RNA, 1701 nt, Artificial Sequence
  hemagglutinin__InfluenzaA__AHV83898
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccaagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggucacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42519 - RNA, 1701 nt, Artificial Sequence; identical to SEQ ID NO: 42512
  hemagglutinin__InfluenzaA__AHV83899

SEQ ID NO: 42520 - RNA, 1701 nt, Artificial Sequence; identical to SEQ ID NO: 42512
  hemagglutinin__InfluenzaA__AHV83900

SEQ ID NO: 42521 - RNA, 1701 nt, Artificial Sequence
  hemagglutinin__InfluenzaA__AHV83901
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcacaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaaacuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42522 - RNA, 1701 nt, Artificial Sequence; identical to SEQ ID NO: 41494
  hemagglutinin__InfluenzaA__AHV83902

SEQ ID NO: 42523 - RNA, 1701 nt, Artificial Sequence; identical to SEQ ID NO: 42521
  hemagglutinin__InfluenzaA__AHV83903

SEQ ID NO: 42524 - RNA, 1701 nt, Artificial Sequence
  hemagglutinin__InfluenzaA__AHV83904
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaagagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccagaaauagcaauaagacccaaagugagggaucaagaagggagaaugaacuacuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagaaaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaaacuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42525 - RNA, 1701 nt, Artificial Sequence
  hemagglutinin__InfluenzaA__AHV83905
augaaggcaauacuaguaguucugcuauauacacuuacaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacggcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugagaaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaaacuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42526 - RNA, 1701 nt, Artificial Sequence
  hemagglutinin__InfluenzaA__AHV83906
augaaggcaauacuaguaguucugcuauacacauuugcaaccgcaaaugcagacacauuauguauagguuaucaugcgaacaauucaacagacacuguagacacaguauuagaaaagaauguaacaguaacacacucuguuaaccuucuagaagacaagcacaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaguaguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccaucuauucaaucuagaggccuauucggggccauugccgguuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaaacuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42527 - RNA, 1701 nt, Artificial Sequence; identical to SEQ ID NO: 42405
  hemagglutinin__InfluenzaA__AHV83907

SEQ ID NO: 42528 - RNA, 1701 nt, Artificial Sequence
  hemagglutinin__InfluenzaA__AHV83908
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaccacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaaaaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggguugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaaacuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42529 - RNA, 1701 nt, Artificial Sequence
  hemagglutinin__InfluenzaA__AHV83911
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcacuuggguaaauguaacauugcuggcuggauccugggaaauccagagugugaaccacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaacauacauccgaucacaauuggaaaauguccaaaguauguaaaaagcacaaaauugagacuggccacaggguugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaaacuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42530 - RNA, 1701 nt, Artificial Sequence
  hemagglutinin__InfluenzaA__AHV83912
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcacaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucgaacaaagguguaacggcagcaugcccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaaacuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42531 - RNA, 1701 nt, Artificial Sequence
  hemagglutinin__InfluenzaA__AHV83913
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgaaggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcagugggcaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42532 - RNA, 1701 nt, Artificial Sequence
  hemagglutinin__InfluenzaA__AHV83915
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcacaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucaaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaaacuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42533 - RNA, 1701 nt, Artificial Sequence; identical to SEQ ID NO: 41526
  hemagglutinin__InfluenzaA__AHV83916

SEQ ID NO: 42534 - RNA, 1701 nt, Artificial Sequence; identical to SEQ ID NO: 42529
  hemagglutinin__InfluenzaA__AHV83917

SEQ ID NO: 42535 - RNA, 1701 nt, Artificial Sequence; identical to SEQ ID NO: 41517
  hemagglutinin__InfluenzaA__AHV83919

SEQ ID NO: 42536 - RNA, 1701 nt, Artificial Sequence
  hemagglutinin__InfluenzaA__AHV83920
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccaagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccagaagagcacacaaaaugccauugacaagauuacuaacaaaguaaacucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42537 - RNA, 1701 nt, Artificial Sequence
  hemagglutinin__InfluenzaA__AHV83921
augaaggcaauacuaguaguucugcuauauacauuugcaaccacaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaaaaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugcaaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42538 - RNA, 1701 nt, Artificial Sequence
  hemagglutinin__InfluenzaA__AHV83922
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagggggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucagccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaaacuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42539 - RNA, 1701 nt, Artificial Sequence
  hemagglutinin__InfluenzaA__AHV83923
augaaggcaauacuaguaguucugcuauauacauuuacaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcacuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuucccaagacaaguucauggcccaaucaugacucgaacaaagguguaacggcagcauguccucacgcuggagcaaaaagcuucuacaaaaauuuaauauggcuaguuaaaaaagggaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuauuauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugaauacccaaaauacucagaggaagcaaaauuaaacagagaaaaaauagaugguguaaagcuggaaucaacaaagauuuaccagauuuuggcgaucuauucaacugucgccaguucauugguacugguagucucccugggggcaaucagcuucuggaugugcucuaaugggucucuacaguguagaauauguauuuaa

SEQ ID NO: 42540 - RNA, 1701 nt, Artificial Sequence; identical to SEQ ID NO: 42452
  hemagglutinin__InfluenzaA__AHV83924

SEQ ID NO: 42541 - RNA, 1701 nt, Artificial Sequence; identical to SEQ ID NO: 42440
  hemagglutinin__InfluenzaA__AHV83925

SEQ ID NO: 42542 - RNA, 1701 nt, Artificial Sequence
  hemagglutinin__InfluenzaA__AHV83926
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguggccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccagaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42543 - RNA, 1701 nt, Artificial Sequence
  hemagglutinin__InfluenzaA__AHV83927
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaccacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggguugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaaacuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42544 - RNA, 1701 nt, Artificial Sequence
  hemagglutinin__InfluenzaA__AHV83928
augaaggcaauacuaguaguucugcuauauacauuuacaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguggccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccagaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42545 - RNA, 1701 nt, Artificial Sequence; identical to SEQ ID NO: 42452
  hemagglutinin__InfluenzaA__AHV83929

SEQ ID NO: 42546 - RNA, 1701 nt, Artificial Sequence
  hemagglutinin__InfluenzaA__AHV83930
augaaggcaauacuaguaauucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaggcaaaauuaaacagagaaaaaauagaugggguaaaacuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42547 - RNA, 1701 nt, Artificial Sequence; identical to SEQ ID NO: 42446
  hemagglutinin__InfluenzaA__AHV83931

SEQ ID NO: 42548 - RNA, 1701 nt, Artificial Sequence; identical to SEQ ID NO: 42495
  hemagglutinin__InfluenzaA__AHV83932

SEQ ID NO: 42549 - RNA, 1701 nt, Artificial Sequence
  hemagglutinin__InfluenzaA__AHV83933
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguaaccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaccaccaucaaaaugagcaggggucaggauaugcagccgaccagaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgcucuauucaacugucgccaguucauugguacugguagucucccugggggcaaucagcuucuggaugugcucuaaugggucucuacaguguagaauauguauuuaa

SEQ ID NO: 42550 - RNA, 1701 nt, Artificial Sequence; identical to SEQ ID NO: 41507
  hemagglutinin__InfluenzaA__AHV83934

SEQ ID NO: 42551 - RNA, 1701 nt, Artificial Sequence; identical to SEQ ID NO: 41501
  hemagglutinin__InfluenzaA__AHV83935

SEQ ID NO: 42552 - RNA, 1701 nt, Artificial Sequence
  hemagglutinin__InfluenzaA__AHV83937
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaacgagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42553 - RNA, 1701 nt, Artificial Sequence
  hemagglutinin__InfluenzaA__AHV83938
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauauccaaagaucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccagaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42554 - RNA, 1701 nt, Artificial Sequence; identical to SEQ ID NO: 42553
  hemagglutinin__InfluenzaA__AHV83939

SEQ ID NO: 42555 - RNA, 1701 nt, Artificial Sequence
  hemagglutinin__InfluenzaA__AHV83940
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccuugugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccagaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuucauggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaaaaaauagauaggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42556 - RNA, 1701 nt, Artificial Sequence; identical to SEQ ID NO: 41497
  hemagglutinin__InfluenzaA__AHV83941

SEQ ID NO: 42557 - RNA, 1701 nt, Artificial Sequence
  hemagglutinin__InfluenzaA__AHV83943
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacaugugcauggaaagugucaaaaaugggacuuaugacuaccccaaauacucagaggaggcaaaauuaaacagagaaaaaauagaugggguaaaacuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42558 - RNA, 1701 nt, Artificial Sequence
  hemagglutinin__InfluenzaA__AHV83944
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacgagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaaacuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42559 - RNA, 1701 nt, Artificial Sequence
  hemagglutinin__InfluenzaA__AHV83945
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacuacugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacaggaaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42560 - RNA, 1701 nt, Artificial Sequence
  hemagglutinin__InfluenzaA__AHV83947
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacagugaaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccagaagagcacacaaaaugccauugacaagauuacuaacaaaguaaacucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42561 - RNA, 1701 nt, Artificial Sequence; identical to SEQ ID NO: 42405
  hemagglutinin__InfluenzaA__AHV83948

SEQ ID NO: 42562 - RNA, 1701 nt, Artificial Sequence; identical to SEQ ID NO: 41494
  hemagglutinin__InfluenzaA__AHV83949

SEQ ID NO: 42563 - RNA, 1701 nt, Artificial Sequence; identical to SEQ ID NO: 42403
  hemagglutinin__InfluenzaA__AHV83950

SEQ ID NO: 42564 - RNA, 1701 nt, Artificial Sequence
  hemagglutinin__InfluenzaA__AHV83953
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaaguaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggaucugggcaaugguuguuucaaaauauaccacaaaugugacaaugccugcauaggaucaaucagaaauggaacuuaugaccacgauguauacagggaugaagcauuaaacaaccgguuccaaaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42565 - RNA, 1701 nt, Artificial Sequence
  hemagglutinin__InfluenzaA__AHV83954
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaccaaaauucugagggaagaggacaagcagcagaucucaaaagcacucaagcagcaaucgaucaaaucaaugggaagcugaaucgauugaucgggaaaaccaacgagaaauuccaccagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguuguuuuguugggguucaucaugugggccugccaaaagggcaacauuaggugcaacauuugcauuuga

SEQ ID NO: 42566 - RNA, 1701 nt, Artificial Sequence
  hemagglutinin__InfluenzaA__AHV83956
augaagacuaucauugcuuugagcuacauucuaugucugguuuuugcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaaacuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcccccauuggcaaaugcaagucugaaugcaucacuccaaauggaagcauucccaaugacaaaccauuccaaaauguaaacaggaucacauauggggccugucccagauauguuaagcaaagcacucugaaauuggcaacaggaaugcgaaauguacaggagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaaucgauugauugggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaaaaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42567 - RNA, 1701 nt, Artificial Sequence
  hemagglutinin__InfluenzaA__AHZ13523
augaagacuaucauugcuuugagcuacauuuucugucugguuuucgcccaaaaacuucccggaaaugacaacagcacagcaacgcugugccugggacaucaugcagugccaaacggaacgcuagugaaaacaaucacgaaugaucagauugaagugacuaaugcuacugagcugguucagaguuccucaacagguagaauaugcgacaguccucaccgaauccuugaugggaaaaacugcacacugauagaugcucuauugggagacccucauugugauggcuuccaaaaugagaaaugggaccuuuuuguugaacgcagcaaagcuuucagcaacuguuacccuuaugaugugccggauuaugccucccuuaggucacuaguugccucaucaggcacccuggaguuuaucaacgaaggcuucaauuggacuggagucacucagagugggggaagcuaugcuugcaaaaggggaucuguuaacaguuucuucaguagauugaauugguuguacaaaucagaaagcaaauauccagugcugaacgugacuaugccaaacaauggcaaauuugacaaauuguacauuugggggguucaccacccgagcacggacaaagaacaaaccaaccuauauguucgagcaucagggagagucacagucucuaccaagagaagccagcaaacuguaaucccgaauaucgggucuagacccuggguaaggggucugucuaguagaauaaguaucuauuggacaauaguaaaaccgggagacauacuguuaauuaauagcacugggaaccuaauugcuccucgggguuacuucaaaauacgcacugggaaaagcucaauaaugaggucagaugcaccuauuggcaccugcaguuaugaaugcaucacuccaaauggaagcauucccaaugacaaacccuuucaaaauguaaacaagaucacauauggggcaugucccagguauguuaagcaaaacacucugaaguuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaccucuggucuuacaacgcugagcuucuuguugcccuggagaaccaacauacaauugaucugacugacucagagaugaacaaauuguuugaaaaaacaaggaagcaacugagggaaaaugcugaggacaugggcaaugguugcuucaaaauauaccacaaaugugacaaugcuugcauagggucaaucagaaauggaacuuauaaccaugauguauacagagacgaagcauuaaacaaccgguuucagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 42568 - RNA, 1698 nt, Artificial Sequence; identical to SEQ ID NO: 34120
  hemagglutinin__InfluenzaA__AHZ13582

SEQ ID NO: 42569 - RNA, 1701 nt, Artificial Sequence
  hemagglutinin__InfluenzaA__AHZ35584
augaagacuaucauugcuuugagcuacauucuaugucugauuuucgcucaagaaauuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugaugacuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacagacaaggaccaaaucuuccuguaugcucaagcaucaggaagaaucacaguaucuaccaaaagaagccaacaggcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagagguauauuuggcgcaauagcggguuucauagaaaauggcugggagggaaugguggaugguugguacgguuucaggcaucaaaauucugagggaaggggacaggcagcagaucucaaaagcacucaagcagcaaucgaucaaaucaaugggaagcugaauagauugaucgggaaaaccaaugagaaauuccaucagauugaaaaagaauucucagaagucgaagggagaauucaagaccuugagaaauauguugaggacacuaaaauagaucucuggucauacaacgcggagcuucuuguugcccuggagaaccaacacacaauugaucugacugacucagaaaugaacaaacuguuugaaaaaacaaagaagcaacugagggaaaaugcugaggauaugggcaaugguuguuucaaaauauaccacaaaugugauaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42570 - RNA, 1701 nt, Artificial Sequence
  hemagglutinin__InfluenzaA__AHZ35608
augaagacuaucauugcuuugagcuacauucuaugucugauuuucgcucaagaaauuccuggaaaugacaacagcacggcaacgcugugccuugggcaccaugcagugccaaacggaacaauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugaugacuuccaaaacaaggaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguuaacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaggcuguaauuccgaauaucggaucuagacccagaguaaggaauauccccagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacgggaccugucccagauaugucaagcaaaacacucugaaauuggcaacaggaaugagaaauguaccagagaaacaaacuagagguauauuuggcgcaauagcggguuucauagaaaauggcugggagggaaugguggaugguugguacgguuucaggcaucaaaauucugagggaaggggacaggcagcagaucucaaaagcacucaagcagcaaucgaucaaaucaaugggaagcugaauagauugaucgggaaaaccaaugagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucugacugacucagaaaugaacaaacuguuugaaaaaacaaagaagcaacugagggaaaaugcugaggauaugggcaaugguuguuucaaaauauaccacaaaugugauaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42571 - RNA, 1701 nt, Artificial Sequence
  hemagglutinin__InfluenzaA__AHZ35620
augaagacuaucauugcuuugagcuacauucuaugucugauuuucgcucaagaaauuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugaugacuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaggcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagagguauauuuggcgcaauagcggguuucauagaaaauggcugggagggaaugguggaugguugguacgguuucaggcaucaaaauucugagggaaggggacaggcagcagaucucaaaagcacucaagcagcaaucgaucaaaucaaugggaagcugaauagauugaucgggaaaaccaaugagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucugacugacucagaaaugaacaaacuguuugaaaaaacaaagaagcaacugagggaaaaugcugaggauaugggcaaugguuguuucaaaauauaccacaaaugugauaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42572 - RNA, 1701 nt, Artificial Sequence; identical to SEQ ID NO: 42569
  hemagglutinin__InfluenzaA__AHZ35632

SEQ ID NO: 42573 - RNA, 1701 nt, Artificial Sequence; identical to SEQ ID NO: 42569
  hemagglutinin__InfluenzaA__AHZ35644

SEQ ID NO: 42574 - RNA, 1701 nt, Artificial Sequence; identical to SEQ ID NO: 42571
  hemagglutinin__InfluenzaA__AHZ35656

SEQ ID NO: 42575 - RNA, 1701 nt, Artificial Sequence; identical to SEQ ID NO: 42569
  hemagglutinin__InfluenzaA__AHZ35668

SEQ ID NO: 42576 - RNA, 1701 nt, Artificial Sequence
  hemagglutinin__InfluenzaA__AHZ35680
augaagacuaucauugcuuugagcuacauucuaugucugauuuucgcucaagaaauuccuggaaaugacaacagcacggcaacgcugugccuugggcaccaugcagugccaaacggaacaauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugaugacuuccaaaacaaggaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaggcuguaauuccgaauaucggaucuagacccagaguaaggaauauccccagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugccugcaucacuccaaauggaagcauucccaaugacaaaccauuccaaaauguaaacaggaucacauacgggaccugucccagauaugucaagcaaaacacucugaaauuggcaacaggaaugagaaauguaccagagaaacaaacuagagguauauuuggcgcaauagcggguuucauagaaaauggcugggagggaaugguggaugguugguacgguuucaggcaucaaaauucugagggaaggggacaggcagcagaucucaaaagcacucaagcagcaaucgaucaaaucaaugggaagcugaauagauugaucgggaaaaccaaugagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucugacugacucagaaaugaacaaacuguuugaaaaaacaaagaagcaacugagggaaaaugcugaggauaugggcaaugguuguuucaaaauauaccacaaaugugauaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42577 - RNA, 1701 nt, Artificial Sequence; identical to SEQ ID NO: 42571
  hemagglutinin__InfluenzaA__AHZ35692

SEQ ID NO: 42578 - RNA, 1701 nt, Artificial Sequence; identical to SEQ ID NO: 42569
  hemagglutinin__InfluenzaA__AHZ35716

SEQ ID NO: 42579 - RNA, 1701 nt, Artificial Sequence; identical to SEQ ID NO: 42576
  hemagglutinin__InfluenzaA__AHZ35728

SEQ ID NO: 42580 - RNA, 1701 nt, Artificial Sequence; identical to SEQ ID NO: 42569
  hemagglutinin__InfluenzaA__AHZ35740

SEQ ID NO: 42581 - RNA, 1701 nt, Artificial Sequence; identical to SEQ ID NO: 42571
  hemagglutinin__InfluenzaA__AHZ35752

SEQ ID NO: 42582 - RNA, 1701 nt, Artificial Sequence; identical to SEQ ID NO: 42569
  hemagglutinin__InfluenzaA__AHZ35764

SEQ ID NO: 42583 - RNA, 1701 nt, Artificial Sequence; identical to SEQ ID NO: 42569
  hemagglutinin__InfluenzaA__AHZ35776

SEQ ID NO: 42584 - RNA, 1701 nt, Artificial Sequence
  hemagglutinin__InfluenzaA__AHZ35823
augaaggcaauacuaguaguucugcuauauacauuugcaaucgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaauucaaccaccuggaaaaaagaauagagaauuuaaauaaaaaaguugaugacgguuuccuggacauuuggacuuacaaugccgaacuguugguucuauuggaaaaugaaagaacuuuggacuaccacgauucaaaugugaagaacuuguaugaaaagguaaggaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42585 - RNA, 1701 nt, Artificial Sequence
  hemagglutinin__InfluenzaA__AHZ35834
augaaggcaauacuaguaguucugcuauauacauuugcaaucgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaauucaaccaccuggaaaaaagaauagagaauuuaaauaaaaaaguugaugacgguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42586 - RNA, 1701 nt, Artificial Sequence; identical to SEQ ID NO: 42585
  hemagglutinin__InfluenzaA__AHZ35845

SEQ ID NO: 42587 - RNA, 1701 nt, Artificial Sequence; identical to SEQ ID NO: 42585
  hemagglutinin__InfluenzaA__AHZ35856

SEQ ID NO: 42588 - RNA, 1701 nt, Artificial Sequence
  hemagglutinin__InfluenzaA__AHZ35867
augaagacuaacauugcuuugagcuacauucuaugucugguuuccgcucaaaaacuuccuggaaaugacaacagcacggcaacgcugugccuugggcaccaugcagugccaaacggaacgauagugaaaacaaucacgaaugaccaaauugaaguuacuaaugcuaccgagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccauuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaauguaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguuguccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42589 - RNA, 1701 nt, Artificial Sequence
  hemagglutinin__InfluenzaA__AHZ35879
augaagacuaacauugcuuugagcuacauucuaugucugguuuccgcucaaaaacuuccuggaaaugacaacagcacggcaacgcugugccuugggcaccaugcagugccaaacggaacgauagugaaaacaaucacgaaugaccaaauugaaguuacuaaugcuaccgagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccauuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaauguaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42590 - RNA, 1701 nt, Artificial Sequence
  hemagglutinin__InfluenzaA__AHZ35891
augaaggcaauacuaguaguucugcuauauacauuugcaaucgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauguuccccaagacaaguucauggcccaaucaugacucgaacaaagguguaacggcagcauguccucaugcuggggcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaauucaaccaccuggaaaaaagaauagagaauuuaaauaaaaaaguugaugacgguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42591 - RNA, 1701 nt, Artificial Sequence; identical to SEQ ID NO: 42585
  hemagglutinin__InfluenzaA__AHZ35902

SEQ ID NO: 42592 - RNA, 1710 nt, Artificial Sequence
  hemagglutinin__InfluenzaA__AHZ35913
augaaggcaauacuaguaguucugcuauauacauuugcaaucgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaauucaaccaccuggaaaaaagaauagagaauuuaaauaaaaaaguugaugacgguuuccuggacauuuggacuuacaaugccgaacuguugguucuauuggaaaaugaaagaacuuuggacuaccacgauucaaaugugaagaacuuguaugaaaggguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42593 - RNA, 1701 nt, Artificial Sequence
  hemagglutinin__InfluenzaA__AHZ35924
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacugagagggguagccccauugcauuuggguaaauguaacauugcuggcuggauccugggaaauccagagugugaaucacucuccacagcaagcucaugguccuacaucguggaaacaucuaguucagacaauggaacgugcuacccaggagauuucaucaauuaugaggagcuaagagagcaauugagcucagugucaucauuugaaagguuugagauauuccccaagacaaguucauggcccaaucaugacucgaacaaagguguaacggcagcauguccucaagcuggagcaaaaagcuucuacaaaaauuuaauauggcuaguuaaaaaaggaaauucauacccaaagcucagcaaauccuacauuaacgauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaguaagacccaaagugagggaucaagaagggagaaugaacuauuauuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaaugucccaaauauguaaaaagcacaaaauugagacuggccacaggauugaggaaugucccguccacucaaucuagaggccuauuuggggccauugccgguuucauugaagggggguggacagggaugguagauggaugguacgguuaucaccaucaaaaugcgcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuauccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42594 - RNA, 1701 nt, Artificial Sequence
  hemagglutinin__InfluenzaA__AHZ35935
augaaggcaauacuaguaguucugcuauauacauuugcaaucgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagaaugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccagaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccuguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugacgguuuccuggacauuuggacuuacaaugccgaauuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42595 - RNA, 1701 nt, Artificial Sequence
  hemagglutinin__InfluenzaA__AHZ35946
augaagacuaacauugcuuugagcuacauucuaugucugguuuccgcucaaaaacuuccuggaaaugacaacagcacggcaacgcugugccuugggcaccaugcagugccaaacggaacgauagugaaaacaaucacgaaugaccaaauugaaguuacuaaugcuaccgagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccauuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaauguaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaacagauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42596 - RNA, 1701 nt, Artificial Sequence; identical to SEQ ID NO: 42585
  hemagglutinin__InfluenzaA__AHZ35958

SEQ ID NO: 42597 - RNA, 1701 nt, Artificial Sequence; identical to SEQ ID NO: 42585
  hemagglutinin__InfluenzaA__AHZ35980

SEQ ID NO: 42598 - RNA, 1701 nt, Artificial Sequence; identical to SEQ ID NO: 42585
  hemagglutinin__InfluenzaA__AHZ35991

SEQ ID NO: 42599 - RNA, 1701 nt, Artificial Sequence; identical to SEQ ID NO: 42585
  hemagglutinin__InfluenzaA__AHZ36002

SEQ ID NO: 42600 - RNA, 1701 nt, Artificial Sequence
  hemagglutinin__InfluenzaA__AHZ36013
augaaggcaauacuaguaguucugcuauauacauuugcaaucgcaaaugcagacacauuauguauagguuaucaugcgaacaauucaacagacacuguagacacaguacuagaaaagaauguaacaguaacacacucuguuaaccuucuagaagacaagcauaacaggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaauucaaccaccuggaaaaaagaauagagaauuuaaauaaaaaaguugaugacgguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42601 - RNA, 1701 nt, Artificial Sequence
  hemagglutinin__InfluenzaA__AHZ36024
augaaggcaauacuaguaguucugcuauauacauuugcaaccgcaaaugcagacacauuauguauaggguaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagggaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagguaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugagaaaugucccgucuauucaaucuagaggccuauuuggggccauugccgguuuuauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaauucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccaugauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggacuuaccagauuuuggcgaucuauucaacugucgccaguucauugguacugguagucucccugggggcaaucaguuucuggaugugcucuaaugggucucuacaguguagaauauguauuuaa

SEQ ID NO: 42602 - RNA, 1701 nt, Artificial Sequence
  hemagglutinin__InfluenzaA__AHZ36035
augaagacuaucauugcuuugagcuacauucuaugucugguuuucgcucaaaaacucccuggaaaugacaacagcacggcaacgcugugccuugggcaccaugcagugccaaacggaacgauagugaaaacaaucacaaaugaccaaauugaaguuacuaaugcuacugagcugauucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucaucuggcacacuggaguuuaacaaugaaagcuucaauuggacuggagucacucaaaacggaacaagcucugcuugcauaaggagaucuaauaauaguuucuuuaguagauugaauugguugacccauuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaauguaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42603 - RNA, 1701 nt, Artificial Sequence
  hemagglutinin__InfluenzaA__AHZ36047
augaagacuaucauugcuuugagcuacauucuaugucugguuuucgcucaaaaacucccuggaaaugacaacagcacggcaacgcugugccuugggcaccaugcagugccaaacggaacgauagugaaaacaaucacaaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucaucuggcacacuggaguuuaacaaugaaagcuucaauuggacuggagucacucaaaacggaacaagcucugcuugcauaaggagaucuaauaauaguuucuuuaguagauugaauugguugacccauuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaauguaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42604 - RNA, 1701 nt, Artificial Sequence
  hemagglutinin__InfluenzaA__AHZ36059
augaaggcaauacuaguaguucugcuauauacauuugcaaucgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaguccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaauucaaccaccuggaaaaaagaauagagaauuuaaauaaaaaaguugaugacgguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42605 - RNA, 1701 nt, Artificial Sequence; identical to SEQ ID NO: 42601
  hemagglutinin__InfluenzaA__AHZ36070

SEQ ID NO: 42606 - RNA, 1701 nt, Artificial Sequence; identical to SEQ ID NO: 42600
  hemagglutinin__InfluenzaA__AHZ36081

SEQ ID NO: 42607 - RNA, 1701 nt, Artificial Sequence; identical to SEQ ID NO: 42601
  hemagglutinin__InfluenzaA__AHZ36092

SEQ ID NO: 42608 - RNA, 1701 nt, Artificial Sequence; identical to SEQ ID NO: 42585
  hemagglutinin__InfluenzaA__AHZ36103

SEQ ID NO: 42609 - RNA, 1701 nt, Artificial Sequence; identical to SEQ ID NO: 42601
  hemagglutinin__InfluenzaA__AHZ36114

SEQ ID NO: 42610 - RNA, 1701 nt, Artificial Sequence; identical to SEQ ID NO: 42585
  hemagglutinin__InfluenzaA__AHZ36125

SEQ ID NO: 42611 - RNA, 1701 nt, Artificial Sequence; identical to SEQ ID NO: 42585
  hemagglutinin__InfluenzaA__AHZ36136

SEQ ID NO: 42612 - RNA, 1701 nt, Artificial Sequence; identical to SEQ ID NO: 42603
  hemagglutinin__InfluenzaA__AHZ36147

SEQ ID NO: 42613 - RNA, 1701 nt, Artificial Sequence
  hemagglutinin__InfluenzaA__AHZ36158
augaaggcaauacuaguaguucugcuauauacauuugcaaucgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaacaagacccaaagugagggaucaagaagggagaaugaacuacuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaauucaaccaccuggaaaaaagaauagagaauuuaaauaaaaaaguugaugacgguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42614 - RNA, 1701 nt, Artificial Sequence; identical to SEQ ID NO: 42585
  hemagglutinin__InfluenzaA__AHZ36169

SEQ ID NO: 42615 - RNA, 1701 nt, Artificial Sequence
  hemagglutinin__InfluenzaA__AHZ36180
augaaggcaauacuaguaguucugcuauauacauuugcaaucgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucgcaauggaaagaaaugcuggaucugguauuaucauuucagauacaccaauccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaauucaaccaccuggaaaaaagaauagagaauuuaaauaaaaaaguugaugacgguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42616 - RNA, 1701 nt, Artificial Sequence; identical to SEQ ID NO: 42589
  hemagglutinin__InfluenzaA__AHZ36191

SEQ ID NO: 42617 - RNA, 1701 nt, Artificial Sequence; identical to SEQ ID NO: 42603
  hemagglutinin__InfluenzaA__AHZ36203

SEQ ID NO: 42618 - RNA, 1701 nt, Artificial Sequence
  hemagglutinin__InfluenzaA__AHZ36215
augaaggcaauacuaguaguucugcuauauacauuugcaaucgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcuuagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaauucaaccaccuggaaaaaagaauagagaauuuaaauaaaaaaguugaugacgguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42619 - RNA, 1701 nt, Artificial Sequence; identical to SEQ ID NO: 42603
  hemagglutinin__InfluenzaA__AHZ36226

SEQ ID NO: 42620 - RNA, 1701 nt, Artificial Sequence; identical to SEQ ID NO: 42585
  hemagglutinin__InfluenzaA__AHZ36238

SEQ ID NO: 42621 - RNA, 1701 nt, Artificial Sequence; identical to SEQ ID NO: 42585
  hemagglutinin__InfluenzaA__AHZ36249

SEQ ID NO: 42622 - RNA, 1701 nt, Artificial Sequence
  hemagglutinin__InfluenzaA__AHZ36260
augaaggcaauacuaguaguucugcuauauacauuugcaaucgcaaaugcagacacauuauguauagguuaucaugcgaacaauucaacagacacuguagacacagugcuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacauuuaguucagacaauggaacguguuacccaggagauuucaucaauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaauucaaccaccuggaaaaaagaauagagaauuuaaauaaaaaaguugaugacgguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42623 - RNA, 1701 nt, Artificial Sequence; identical to SEQ ID NO: 42571
  hemagglutinin__InfluenzaA__AHZ36271

SEQ ID NO: 42624 - RNA, 1701 nt, Artificial Sequence; identical to SEQ ID NO: 42585
  hemagglutinin__InfluenzaA__AHZ36283

SEQ ID NO: 42625 - RNA, 1701 nt, Artificial Sequence; identical to SEQ ID NO: 42571
  hemagglutinin__InfluenzaA__AHZ36294

SEQ ID NO: 42626 - RNA, 1701 nt, Artificial Sequence
  hemagglutinin__InfluenzaA__AHZ36306
augaaggcaauacuaguaguucugcuauauacauuugcaaucgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcaaaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaauucaaccaccuggaaaaaagaauagagaauuuaaauaaaaaaguugaugacgguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42627 - RNA, 1701 nt, Artificial Sequence; identical to SEQ ID NO: 42585
  hemagglutinin__InfluenzaA__AHZ36317

SEQ ID NO: 42628 - RNA, 1701 nt, Artificial Sequence; identical to SEQ ID NO: 42585
  hemagglutinin__InfluenzaA__AHZ36328

SEQ ID NO: 42629 - RNA, 1701 nt, Artificial Sequence
  hemagglutinin__InfluenzaA__AHZ36339
augaaggcaauacuaguaguucugcuauauacauuugcaaucgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuguaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaauucaaccaccuggaaagaagaauagagaauuuaaauaaaaaaguugaugacgguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42630 - RNA, 1701 nt, Artificial Sequence
  hemagglutinin__InfluenzaA__AHZ36362
augaaggcaauacuaguaguucugcuauauacauuugcaaucgcaaaugcagacacauuauguauagguuaucaugcgaacaauucaacagacacuguagacacaguacuagaaaagaauguaacaguaacacacucuauuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuguaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaauucaaccaccuggaaagaagaauagagaauuuaaauaaaaaaguugaugacgguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42631 - RNA, 1701 nt, Artificial Sequence
  hemagglutinin__InfluenzaA__AHZ36385
augaagacuaucauugcuuugagcuacauucuaugucugauuuucgcucaagaaauuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugaugacuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaggcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagagguauauuuggcgcaauagcggguuucauagaaaauggcugggagggaaugguggaugguugguacgguuucaggcaucaaaauucugagggaaggggacaggcagcagaucucaaaagcacucaagcagcaaucgaucaaaucaaugggaagcugaauagauugaucgggaaaaccaaugagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucugacugacucagaaaugaacaaacuguuugaaaaaacaaagaagcaacugagggaaaaugcugaggauaugggcaaugguuguuucaaaauauaccacaaaugugauaaugccugcauagggucaaucagaaauggaacuuaugaccacgauguguacagagaugaagcauuaaacaaccgauucaagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42632 - RNA, 1701 nt, Artificial Sequence
  hemagglutinin__InfluenzaA__AHZ36397
augaagacuaucauugcuuugagcuacauucuaugucugauuuucgcucaagaaauuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugaugacuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaggcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagagguauauuuggcgcaauagcggguuucauagaaaauggcugggagggaaugguggaugguugguacgguuucaggcaucaaaauucugagggaaggggacaggcagcagaucucaaaagcacucaagcagcaaucgaucaaaucaaugggaagcugaauagauugaucgggaaaaccaaugagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucugacugacucagaaaugaacaaacuguuugaaaaaacaaagaagcaacugagggaaaaugcugaggauaugggcaaugguuguuucaaaauauaccacaaaugugauaaugccugcauaggaucaaucagaaauggaacuuaugaccacaauguguacagagaugaagcauuaaacaaccgauucaagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42633 - RNA, 1701 nt, Artificial Sequence; identical to SEQ ID NO: 42571
  hemagglutinin__InfluenzaA__AHZ36409

SEQ ID NO: 42634 - RNA, 1701 nt, Artificial Sequence
  hemagglutinin__InfluenzaA__AHZ36433
augaagacuaucauugcuuugagcuacauucuaugucugauuuucgcucaagaaauuccuggaaaugacaacagcacggcaacgcugugccuugggcaccaugcagugccaaacggaacaauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugaugacuuccaaaacaaggaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaggcuguaauuccgaauaucggaucuagacccagaguaaggaauauccccagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacgggaccugucccagauaugucaagcaaaacacucugaaauuggcaacaggaaugagaaauguaccagagaaacaaacuagagguauauuuggcgcaauagcggguuucauagaaaauggcugggagggaaugguggaugguugguacgguuucaggcaucaaaauucugagggaaggggacaggcagcagaucucaaaagcacucaagcagcaaucgaucaaaucaaugggaagcugaauagauugaucgggaaaaccaaugagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucugacugacucagaaaugaacaaacuguuugaaaaaacaaagaagcaacugagggaaaaugcugaggauaugggcaaugguuguuucaaaauauaccacaaaugugauaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42635 - RNA, 1701 nt, Artificial Sequence
  hemagglutinin__InfluenzaA__AHZ36445
augaagacuaucauugcuuugagcuacauucuaugucugauuuucgcucaagaaauuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugaugacuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacagacaaggaccaaaucuuccuguaugcucaagcaucaggaagaaucacaguaucuaccaaaagaagccaacaggcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagagguauauuuggcgcaauagcggguuucauagaaaauggcugggagggaaugguggaugguugguacgguuucaggcaucaaaauucugagggaaggggacaggcagcagaucucaaaagcacucaagcagcaaucgaucaaaucaaugggaagcugaauagauugaucgggaaaaccaaugagaaauuccaucagauugaaaaagaauucucagaagucgaagggagaauucaagaccuugagaaauauguugaggacacuaaaauagaucucuggucauacaacgcggagcuucuuguugcccuggagaaccaacacacaauugaucugacugacucagaaaugaacaaacuguuugaaaaaacaaagaagcaacugagggaaaaugcugaggauaugggcaaugguuguuucaaaauauaccacaaaugugaugaugccugcauaggaucaaucagaaauggaacuuaugaccacgauguguacagagaugaagcauuaaacaacagauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42636 - RNA, 1701 nt, Artificial Sequence; identical to SEQ ID NO: 42569
  hemagglutinin__InfluenzaA__AHZ36457

SEQ ID NO: 42637 - RNA, 1701 nt, Artificial Sequence; identical to SEQ ID NO: 42571
  hemagglutinin__InfluenzaA__AHZ36469

SEQ ID NO: 42638 - RNA, 1701 nt, Artificial Sequence
  hemagglutinin__InfluenzaA__AHZ36481
augaagacuaucauugcuuugagcuacauucuaugucugauuuucgcucaagaaauuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugaugacuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaggcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaaaugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagagguauauuuggcgcaauagcggguuucauagaaaauggcugggagggaaugguggaugguugguacgguuucaggcaucaaaauucugagggaaggggacaggcagcagaucucaaaagcacucaagcagcaaucgaucaaaucaaugggaagcugaauagauugaucgggaaaaccaaugagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucugacugacucagaaaugaacaaacuguuugaaaaaacaaagaagcaacugagggaaaaugcugaggauaugggcaaugguuguuucaaaauauaccacaaaugugauaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42639 - RNA, 1701 nt, Artificial Sequence
  hemagglutinin__InfluenzaA__AHZ36493
augaagacuaucauugcuuugagcuacauucuaugucugauuuucgcucaagaaauuccuggaaaugacaacagcacggcaacgcugugccuugggcaccaugcagugccaaacggaacaauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugaugacuuccaaaacaaggaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaggcuguaauuccgaauaucggaucuagacccagaguaaggaauauccccagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugccugcaucacuccaaauggaagcauucccaaugacaaaccauuccaaaauguaaacaggaucacauacgggaccugucccagauaugucaagcaaaacacucugaaauuggcaacaggaaugagaaauguaccagagaaacaaacuagagguauauuuggcgcaauagcggguuucauagaaaauggcugggagggaaugguggaugguugguacgguuucaggcaucaaaauucugagggaaggggacaggcagcagaucucaaaagcacucaagcagcaaucgaucaaaucaaugggaagcugaauagauugaucgggaaaaccaaugagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucugacugacucagaaaugaacaaacuguuugaaaaaacaaagaagcaacugagggaaaaugcugaggauaugggcaaugguuguuucaaaauauaccacaaaugugauaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42640 - RNA, 1701 nt, Artificial Sequence; identical to SEQ ID NO: 42634
  hemagglutinin__InfluenzaA__AHZ36505

SEQ ID NO: 42641 - RNA, 1701 nt, Artificial Sequence
  hemagglutinin__InfluenzaA__AHZ36517
augaagacuaucauugcuuugagcuacauucuaugucugauuuucgcucaagaaauuccuggaaaugacaacagcacggcaacgcugugccuugggcaccaugcagugccaaacggaacaauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugaugacuuccaaaacaaggaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaggcuguaauuccgaauaucggaucuagacccagaguaaggaauauccccagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacgggaccugucccagauaugucaagcaaaacacucugaaauuggcaacaggaaugagaaauguaccagagaaacaaacuagagguauauuuggcgcaauagcggguuucauagaaaauggcugggagggaaugguggaugguugguacgguuucaggcaucaaaauucugagggaaggggacaggcagcagaucucaaaagcacucaagcagcaaucgaucaaaucaaugggaagcugaauagauugaucgggaaaaccaaugagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucugacugacucagaaaugaacaaacuguuugaaaaaacaaagaagcaacugagggaaaaugcugaggauaugggcaaugguuguuucaaaauauaccacaaaugugauaaugccugcauaggaucaaucagaaauggaacuuaugaccacgacguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42642 - RNA, 1701 nt, Artificial Sequence
  hemagglutinin__InfluenzaA__AHZ36529
augaagacuaucauugcuuugagcuacauucuaugucugauuuucgcucaagaaauuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugaugacuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacagacaaggaccaaaucuuccuguaugcucaagcaucaggaagaaucacaguaucuaccaaaagaagccaacaggcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucuucaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagagguauauuuggcgcaauagcggguuucauagaaaauggcugggagggaaugguggaugguugguacgguuucaggcaucaaaauucugagggaaggggacaggcagcagaucucaaaagcacucaagcagcaaucgaucaaaucaaugggaagcugaauagauugaucgggaaaaccaaugagaaauuccaucagauugaaaaagaauucucagaagucgaagggagaauucaagaccuugagaaauauguugaggacacuaaaauagaucucuggucauacaacgcggagcuucuuguugcccuggagaaccaacacacaauugaucugacugacucagaaaugaacaaacuguuugaaaaaacaaagaagcaacugagggaaaaugcugaggauaugggcaaugguuguuucaaaauauaccacaaaugugauaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42643 - RNA, 1701 nt, Artificial Sequence
  hemagglutinin__InfluenzaA__AHZ36541
augaagacuaucauugcuuugagcuacauucuaugucugauuuucgcucaagaaauuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugaugacuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacagacaaggaccaaaucuuccuguaugcucaagcaucaggaagaaucacaguaucuaccaaaagaagccaacaggcaguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagagguauauuuggcgcaauagcggguuucauagaaaauggcugggagggaaugguggaugguugguacgguuucaggcaucaaaauucugagggaaggggacaggcagcagaucucaaaagcacucaagcagcaaucgaucaaaucaaugggaagcugaauagauugaucgggaaaaccaaugagaaauuccaucagauugaaaaagaauucucagaagucgaagggagaauucaagaccuugagaaauauguugaggacacuaaaauagaucucuggucauacaacgcggagcuucuuguugcccuggagaaccaacacacaauugaucugacugacucagaaaugaacaaacuguuugaaaaaacaaagaagcaacugagggaaaaugcugaggauaugggcaaugguuguuucaaaauauaccacaaaugugauaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42644 - RNA, 1701 nt, Artificial Sequence
  hemagglutinin__InfluenzaA__AHZ36553
augaagacuaucauugcuuugagcuacauucuaugucugauuuucgcucaagaaauuccuggaaaugacaacagcacggcaacgcugugccuugggcaccaugcagugccaaacggaacaauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugaugacuuccaaaacaaggaaugggaccuuuuuguugaacgaagcaaagcccacagcaacuguuacccuuaugaugugccggauuaugccucccuuaggucacuaguugccucauccggcacacuggaguuuaaaaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaggcuguaauuccgaauaucggaucuagacccagaguaaggaauauccccagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacgggaccugucccagauaugucaagcaaaacacucugaaauuggcaacaggaaugagaaauguaccagagaaacaaacuagagguauauuuggcgcaauagcggguuucauagaaaauggcugggagggaaugguggaugguugguacgguuucaggcaucaaaauucugagggaaggggacaggcagcagaucucaaaagcacucaagcagcaaucgaucaaaucaaugggaagcugaauagauugaucgggaaaaccaaugagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucugacugacucagaaaugaacaaacuguuugaaaaaacaaagaagcaacugagggaaaaugcugaggauaugggcaaugguuguuucaaaauauaccacaaaugugauaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42645 - RNA, 1701 nt, Artificial Sequence; identical to SEQ ID NO: 42569
  hemagglutinin__InfluenzaA__AHZ36565

SEQ ID NO: 42646 - RNA, 1701 nt, Artificial Sequence; identical to SEQ ID NO: 42569
  hemagglutinin__InfluenzaA__AHZ36577

SEQ ID NO: 42647 - RNA, 1701 nt, Artificial Sequence; identical to SEQ ID NO: 42569
  hemagglutinin__InfluenzaA__AHZ36589

SEQ ID NO: 42648 - RNA, 1701 nt, Artificial Sequence; identical to SEQ ID NO: 42644
  hemagglutinin__InfluenzaA__AHZ36601

SEQ ID NO: 42649 - RNA, 1701 nt, Artificial Sequence
  hemagglutinin__InfluenzaA__AHZ36613
augaagacuaucauugcuuugagcuacauucuaugucugauuuucgcucaagaaauuccuggaaaugacaacagcacggcaacgcugugccuugggcaccaugcagugccaaacggaacaauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugaugacuuccaaaacaaggaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaggcuguaauuccgaauaucggaucuagacccagaguaaggaauauccccagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacgggaccugucccagauaugucaagcaaaacacucugaaauuggcaacaggaaugagaaauguaccagagaaacaaacuagagguauauuuggcgcaauagcggguuucauagaaaauggcugggagggaaugguggaugguugguacgguuucaggcaucaaaauucugagggaaggggacaggcagcagaucucaaaagcacucaagcagcaaucgaucaaaucaaugggaagcugaauagauugaucgggaaaaccaaugagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucugacugacucagaaaugaacaaacuguuugaaaaaacaaagaagcaacugagggaaaaugcugaggauaugggcaaugguuguuucaaaauauaccacaaaugugauaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccacaucauguuuuuugcuuuguguugcuuuguugggguucaucaugugggccugccaaaaaggcaacauuaggugcaacauuugcauuuga

SEQ ID NO: 42650 - RNA, 1701 nt, Artificial Sequence
  hemagglutinin__InfluenzaA__AHZ36625
augaagacuaucauugcuuugagcuacauucuaugucugauuuucgcucaagaaauuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugaugacuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacagacaaggaccaaaucuuccuguaugcucaagcaucaggaagaaucacaguaucuaccaaaagaagccaacaggcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagagguauauuuggcgcaauagcggguuucauagaaaauggcugggagggaaugguggaugguugguacgguuucaggcaucaaaauucugagggaaggggacaggcagcagaucuuaaaagcacucaagcagcaaucgaucaaaucaaugggaagcugaauagauuaaucgggaaaaccaaugagaaauuccaucagauugaaaaagaauucucagaagucgaagggagaauucaagaccuugagaaauauguugaggacacuaaaauagaucucuggucauacaacgcggagcuucuuguugcccuggagaaccaacacacaauugaucugacugacucagaaaugaacaaacuguuugaaaaaacaaagaagcaacugagggaaaaugcugaggauaugggcaaugguuguuucaaaauauaccacaaaugugauaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42651 - RNA, 1701 nt, Artificial Sequence; identical to SEQ ID NO: 42634
  hemagglutinin__InfluenzaA__AHZ36637

SEQ ID NO: 42652 - RNA, 1701 nt, Artificial Sequence
  hemagglutinin__InfluenzaA__AHZ36649
augaagacuaucauugcuuugagcuacauucuaugucugauuuucgcucaagaaauuccuggaaaugacaacagcacggcaacgcugugccuugggcaccaugcagugccaaacggaacaauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugaugacuuccaaaacaaggaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaggcuguaauuccgaauaucggaucuagacccagaguaaggaauauccccagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacgggaccugucccagauaugucaagcaaaacacucugaaauuggcaacaggaaugagaaauguaccagagaaacaaacuagagguauauuuggcgcaauagcggguuucauagaaaauggcugggagggaaugguggaugguugguacgguuucaggcaucaaaauucugagggaaggggacaggcagcagaucucaaaagcacucaagcagcaaucgaucaaaucaaugggaagcugaauagauugaucgggaaaaccaaugagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucugacugacucagaaaugaacaaacuguuugaaaaaacaaagaagcaacugagggaaaaugcugaggauaugggcaauggcuguuucaaaauauaccacaaaugugauaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42653 - RNA, 1701 nt, Artificial Sequence; identical to SEQ ID NO: 40647
  hemagglutinin__InfluenzaA__AHZ36661

SEQ ID NO: 42654 - RNA, 1701 nt, Artificial Sequence; identical to SEQ ID NO: 40647
  hemagglutinin__InfluenzaA__AHZ36673

SEQ ID NO: 42655 - RNA, 1701 nt, Artificial Sequence
  hemagglutinin__InfluenzaA__AHZ36685
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagagaguugaguugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42656 - RNA, 1683 nt, Artificial Sequence; identical to SEQ ID NO: 40492
  hemagglutinin__InfluenzaA__AHZ39698

SEQ ID NO: 42657 - RNA, 1683 nt, Artificial Sequence
  hemagglutinin__InfluenzaA__AHZ39722
augaacacucaaauccugguauucgcucugauugcgaucauuccaacaaaugcagacaaaaucugccucggacaucaugccgugucaaacggaaccaaaguaaacacauuaacugaaagaggaguggaagucgucaaugcaacugaaacaguggaacgaacaaacauccccaggaucugcucaaaagggaaaaggacaguugaccucggucaauguggacuccuggggacaaucacuggaccaccucaaugugaccaauuccuagaauuuucagccgauuuaauuauugagaggcgagaaggaagugaugucuguuauccugggaaauucgugaaugaagaagcucugaggcaaauucucagagaaucaggcggaauugacaaggaagcaaugggauucacauacaguggaauaagaacugauggagcaaccagugcauguaggagaucaggaucuucauucuaugcagaaaugaaauggcuccugucaaacacagaugaugcugcauucccgcagaugacuaagucauauaaaaauacaagaaaaagcccagcucuaauaguaugggggauccaucauuccguaucaacugcagagcaaaccaagcuauaugggaguggaaacaaacuggugacaguugggaguucuaauuaucaacaaucuuuuguaccgaguccaggagcgagaccacaaguuaauggucuaucuggaagaauugacuuucauuggcuaaugcuaaaucccaaugauacagucacuuucaguuucaauggggcuuucauagcuccagaccgugcaagcuuccugagaggaaaaucuaugggaauccagaguggaguacagguugaugccaauugugaaggggacugcuaucauaguggagggacaauaauaaguaacuugccauuucagaacauagauagcagggcaguuggaaaauguccgagauauguuaagcaaaggagucugcugcuagcaacagggaugaagaauguuccugagauuccaaagggaagaggccuauuuggugcuauagcggguuucauugaaaauggaugggaaggccuaauugaugguugguaugguuucagacaccagaaugcacagggagagggaacugcugcagauuacaaaagcacucaaucggcaauugaucaaauaacaggaaaauuaaaccggcuuauagaaaaaaccaaccaacaauuugaguugauagacaaugaauucaaugagguagagaagcaaaucgguaaugugauaaauuggaccagagauucuauaacagaaguguggucauacaaugcugaacucuugguagcaauggagaaccagcauacaauugaucuggcugauucagaaauggacaaacuguacgaacgagugaaaagacagcugagagagaaugcugaagaagauggcacugguugcuuugaaauauuucacaagugugaugaugacuguauggccaguauuagaaauaacaccuaugaucacagcaaauacagggaagaggcaaugcaaaauagaauacagauugacccagucaaacuaagcagcggcuacaaagaugugauacuuugguuuagcuucggggcaucauguuucauacuucuagccauuguaaugggccuugucuucauauguguaaagaauggaaacaugcggugcacuauuuguauauaa

SEQ ID NO: 42658 - RNA, 1683 nt, Artificial Sequence; identical to SEQ ID NO: 42657
  hemagglutinin__InfluenzaA__AHZ39734

SEQ ID NO: 42659 - RNA, 1683 nt, Artificial Sequence
  hemagglutinin__InfluenzaA__AHZ39746
augaacacucaaauccugguauucgcucugauugcgaucauuccaacaaaugcagacaaaaucugccucggacaucaugccgugucaaacggaaccaaaguaaacacauuaacugaaagaggaguggaagucgucaaugcaacugaaacaguggaacgaacaaacauccccaggaucugcucaaaagggaaaaggacaguugaccucggucaauguggacuccuggggacaaucacuggaccaccucaaugugaccaauuccuagaauuuucagccgauuuaauuauugagaggcgagaaggaagugaugucuguuauccugggaaauucgugaaugaagaagcucugaggcaaauucucagagaaucaggcggaauugacaaggaagcaaugggauucacauacaguggaauaagaacuaauggagcaaccagugcauguaggagaucaggaucuucauucuaugcagaaaugaaauggcuccugucaaacacagauaaugcugcauucccgcagaugacuaagucauauaaaaauacaagaaaaagcccagcucuaauaguaugggggauccaucauuccguaucaacugcagagcaaaccaagcuauaugggaguggaaacaaacuggugacaguugggaguucuaauuaucaacaaucuuuuguaccgaguccaggagagagaccacaaguuaauggucuaucuggaagaauugacuuucauuggcuaaugcuaaaucccaaugauacagucacuuucaguuucaauggggcuuucauagcuccagaccgugcaagcuuccugagaggaaaaucuaugggaauccagaguggaguacagguugaugccaauugugaaggggacugcuaucauaguggagggacaauaauaaguaacuugccauuucagaacauagauagcagggcaguuggaaaauguccgagauauguuaagcaaaggagucugcugcuagcaacagggaugaagaauguuccugagauuccaaagggaagaggccuauuuggugcuauagcggguuucauugaaaauggaugggaaggccuaauugaugguugguaugguuucagacaccagaaugcacagggagagggaacugcugcagauuacaaaagcacucaaucggcaauugaucaaauaacaggaaaauuaaaccggcuuauagaaaaaaccaaccaacaauuugaguugauagacaaugaauucaaugagguagagaagcaaaucgguaaugugauaaauuggaccagagauucuauaacagaaguguggucauacaaugcugaacucuugguagcaauggagaaccagcauacaauugaucuggcugauucagaaauggacaaacuguacgaacgagugaaaagacagcugagagagaaugcugaagaagauggcacugguugcuuugaaauauuucacaagugugaugaugacuguauggccaguauuagaaauaacaccuaugaucacagcaaauacagggaagaggcaaugcaaaauagaauacagauugacccagucaaacuaagcagcggcuacaaagaugugauacuuugguuuagcuucggggcaucauguuucauacuucuagccauuguaaugggccuugucuucauauguguaaagaauggaaacaugcggugcacuauuuguauauaa

SEQ ID NO: 42660 - RNA, 1683 nt, Artificial Sequence; identical to SEQ ID NO: 42657
  hemagglutinin__InfluenzaA__AHZ39758

SEQ ID NO: 42661 - RNA, 1683 nt, Artificial Sequence; identical to SEQ ID NO: 42657
  hemagglutinin__InfluenzaA__AHZ39770

SEQ ID NO: 42662 - RNA, 1683 nt, Artificial Sequence; identical to SEQ ID NO: 42657
  hemagglutinin__InfluenzaA__AHZ39782

SEQ ID NO: 42663 - RNA, 1701 nt, Artificial Sequence; identical to SEQ ID NO: 40391
  hemagglutinin__InfluenzaA__AHZ39794

SEQ ID NO: 42664 - RNA, 1701 nt, Artificial Sequence
  hemagglutinin__InfluenzaA__AHZ39806
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaguacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugagaaagaauucucagaaguagaagggagaauucaggaccuugagaaauauguugaggacacaaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaaaucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42665 - RNA, 1701 nt, Artificial Sequence
  hemagglutinin__InfluenzaA__AHZ39818
augaagacuaucauugcuuugagcuacauucuaugucugguuuucgcucaaaaacucccuggaaaugacaacagcacggcaacgcugugccuugggcaccaugcagugccaaacggaacgauagugaaaacaauaacaaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucaucuggcacacuggaguuuaacaaugaaagcuucaauuggacuggagucacucaaaacggaacaagcucugcuugcauaaggagaucuaauaauaguuucuuuaguagauugaauugguugacccauuuaaacuucaaauacccagcauugaacgugacuaugccaaacaaugaacaauuugacaaauuguacauuugggggguucaccacccggguacggacaaggaccaaaccuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacggaguggaaaaagcucaauaaugagaucagaugcacccauuggcaaauguaauucugcaugcaucacuccaaauggaagcauucccaaugacaaaccauuccaaaauguaaacaggaucacauacggggccugucccagauauguuaaacaaaacacucugaaauuggcaacaggaaugagaaauguaccagagaaacaaacuagaggcauauuuggcgcaauagcugguuucauagaaaaugguugggagggaaugguggaugguugguacgguuucagacaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuuauuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 42666 - RNA, 1701 nt, Artificial Sequence; identical to SEQ ID NO: 40393
  hemagglutinin__InfluenzaA__AHZ39841

SEQ ID NO: 42667 - RNA, 1701 nt, Artificial Sequence
  hemagglutinin__InfluenzaA__AHZ39853
augaagaccaucauugcuuugagcuacauucuaugucuaguuuucgcucaagaacuuccuggaaaugacgacagcacggcaacgcugugccuugggcaccaugcagugccaaacggaacgauagugaaaacaaucacgaaugaccgaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaaagaagcaaagcccacagcaacuguuacccuuaugaugugccggauuaugccucccuuaggucacuaguugccucaucuggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaaacuguaauuccgaauaucggaucuagacccagaguaaggaauaucccuagcagaguaagcaucuauuggacaauaguaaaaccaggagacauacuuuugauuaacagcacagggaaucuaauugcuccuagggguuacuucaaaauacgaaguggaaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggugcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaauggcuguuucaaaauauaccacaaaugugacaaugccugcauaggaucaaucagaaauggaacuuaugaucacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42668 - RNA, 1701 nt, Artificial Sequence
  hemagglutinin__InfluenzaA__AHZ39865
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccaaaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42669 - RNA, 1701 nt, Artificial Sequence
  hemagglutinin__InfluenzaA__AHZ39877
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagauuaagggaguugagcuuaagucaggguacaaagauuggauccuauggauuuccuuugccacaucauguuuuuugcuuuguguugcuuuguugggguucaucaugugggccugccaaaagggcaacauuaggugcaacauuugcauuuga

SEQ ID NO: 42670 - RNA, 1701 nt, Artificial Sequence; identical to SEQ ID NO: 40407
  hemagglutinin__InfluenzaA__AHZ39889

SEQ ID NO: 42671 - RNA, 1701 nt, Artificial Sequence
  hemagglutinin__InfluenzaA__AHZ39913
augaagacuaucauugcuuugagcuacauucuaugucuaguuuucgcccaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucugauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaaucugugaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggaaaaugcaauucugaaugcaucacuccaaauggaagcauucccaaugacaaaccauuccaaaauguaaacaggaucacauacggggccuguccuagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggaaaaccaacauacaauugaucuaacugacucagaaaugaacaaacuguuugaaaaaacaaagaagcaacugagagaaaaugcugaagauaugggcaauggcuguuucaaaauauaccacaaaugugacaaugccugcauaggaucaaucagaaauggaacuuauaaccacgauguauacagagaugaagcauuaaacaaccgguuccagaucaagggaguugagcugaagucaggguauaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42672 - RNA, 1701 nt, Artificial Sequence
  hemagglutinin__InfluenzaA__AHZ39925
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaagggauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42673 - RNA, 1701 nt, Artificial Sequence; identical to SEQ ID NO: 40393
  hemagglutinin__InfluenzaA__AHZ39937

SEQ ID NO: 42674 - RNA, 1701 nt, Artificial Sequence
  hemagglutinin__InfluenzaA__AHZ39949
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguccaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaguuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42675 - RNA, 1701 nt, Artificial Sequence; identical to SEQ ID NO: 40393
  hemagglutinin__InfluenzaA__AHZ39961

SEQ ID NO: 42676 - RNA, 1701 nt, Artificial Sequence
  hemagglutinin__InfluenzaA__AHZ39973
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggaaggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42677 - RNA, 1701 nt, Artificial Sequence
  hemagglutinin__InfluenzaA__AHZ39985
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcauccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagauuaagggaguugagcuuaagucaggguacaaagauuggauccuauggauuuccuuugccacaucauguuuuuugcuuuguguugcuuuguugggguucaucaugugggccugccaaaagggcaacauuaggugcaacauuugcauuuga

SEQ ID NO: 42678 - RNA, 1701 nt, Artificial Sequence; identical to SEQ ID NO: 40393
  hemagglutinin__InfluenzaA__AHZ39997

SEQ ID NO: 42679 - RNA, 1701 nt, Artificial Sequence
  hemagglutinin__InfluenzaA__AHZ40009
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagauuuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcacuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42680 - RNA, 1701 nt, Artificial Sequence; identical to SEQ ID NO: 40393
  hemagglutinin__InfluenzaA__AHZ40021

SEQ ID NO: 42681 - RNA, 1701 nt, Artificial Sequence
  hemagglutinin__InfluenzaA__AHZ40033
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugccccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42682 - RNA, 1701 nt, Artificial Sequence; identical to SEQ ID NO: 40391
  hemagglutinin__InfluenzaA__AHZ40045

SEQ ID NO: 42683 - RNA, 1701 nt, Artificial Sequence
  hemagglutinin__InfluenzaA__AHZ40060
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42684 - RNA, 1701 nt, Artificial Sequence; identical to SEQ ID NO: 40393
  hemagglutinin__InfluenzaA__AHZ40072

SEQ ID NO: 42685 - RNA, 1701 nt, Artificial Sequence
  hemagglutinin__InfluenzaA__AHZ40084
augaagacuaucauugcuuugagcuacauucuaugucugguuuucgcucaaaaacuuccuggaaaugacaauagcacggcaacgcugugccuuggacaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42686 - RNA, 1701 nt, Artificial Sequence
  hemagglutinin__InfluenzaA__AHZ40096
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacagcccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucuaaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugcuugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42687 - RNA, 1701 nt, Artificial Sequence
  hemagglutinin__InfluenzaA__AHZ40108
augaagacuaucauugcuuugagcuacauucuaugucuaguuuucgcccaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaaguuucaauuggacuggagucacucaaaacggaacaagcucugcuugcauaaggagaucugauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaaucugugaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggaaaaugcaauucugaaugcaucacuccaaauggaagcauucccaaugacaaaccauuccaaaauguaaacaggaucacauacggggccuguccuagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggaaaaccaacauacaauugaucuaacugacucagaaaugaacaaacuguuugaaaaaacaaagaagcaacugagagaaaaugcugaagauaugggcaauggcuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42688 - RNA, 1701 nt, Artificial Sequence; identical to SEQ ID NO: 42664
  hemagglutinin__InfluenzaA__AHZ40120

SEQ ID NO: 42689 - RNA, 1701 nt, Artificial Sequence
  hemagglutinin__InfluenzaA__AHZ40130
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugccacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggauuacauacggggccugucccagauauguuaagcaaagcacccugaaauuggcaacaggaaugcgaaauguaccagagaaacaaacuagaggcauauuuggugcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaguugagcugaagucaggguacaaaaauuggauccuauggauuuccuuugccauaucauguuuuuugcuuuguguugcuuuguugggguucaucaugugggcaugccaaaagggcaacauuaggugcaacauuugcauuuga

SEQ ID NO: 42690 - RNA, 1701 nt, Artificial Sequence
  hemagglutinin__InfluenzaA__AHZ40142
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucaaauccuugauggagaaaacugcacgcuaauagaugcucuauugggagacccucagugugauggcuuucaagauaagaaaugggaccuuuuuguugaacgaagcaaagccuacagcaacuguuacccuuaugaugugccggauuaugccucccuuaggucacuaguugccucauccggcacacuggaguuuaacaaugaaaacuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccgggcacggacaaggaccaaaucuuucuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacagaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagggaugaagcauugaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42691 - RNA, 1701 nt, Artificial Sequence
  hemagglutinin__InfluenzaA__AHZ40154
augaagacuaucauugcuuugagcuacauucuaugucuggguuucgcucaagaacuuccuggaaaugacaacagcacggcaacguugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggggaucuaauaauaguuucuuuaguagauugaauugguuaacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucaccguaucuaccaaaagaagccaacaagcuguaauuccgaauaucggaucuagacccagaguaaggaauaucccuagcagaguaagcaucuauuggacaauaguaaaaccgggagacaugcuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggauaacauacggggccugucccagauauguuaagcaaaacacucugaaauuggcaacaggaaugagaaauguaccagagaaacaaacuagaggcauauuuggcgcaauagcggguuucauagaaaaugguugggaaggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaauguaacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42692 - RNA, 1701 nt, Artificial Sequence
  hemagglutinin__InfluenzaA__AHZ40166
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaaggugugacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaauagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaagauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaucuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42693 - RNA, 1701 nt, Artificial Sequence; identical to SEQ ID NO: 40393
  hemagglutinin__InfluenzaA__AHZ40177

SEQ ID NO: 42694 - RNA, 1701 nt, Artificial Sequence
  hemagglutinin__InfluenzaA__AHZ40189
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaacgaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcauauauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaacguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42695 - RNA, 1701 nt, Artificial Sequence; identical to SEQ ID NO: 40393
  hemagglutinin__InfluenzaA__AHZ40201

SEQ ID NO: 42696 - RNA, 1701 nt, Artificial Sequence
  hemagglutinin__InfluenzaA__AHZ40213
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcuaguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42697 - RNA, 1701 nt, Artificial Sequence
  hemagglutinin__InfluenzaA__AHZ40225
augaagaccaucauugcuuugagcuacauucuaugucuaguuuuugcucaagaacuuccuggaaaugacgacagcacggcaacgcugugccuugggcaccaugcagugccaaacggaacgauagugaaaacaaucacgaaugaccaaauugaaguuacuaaugcuacugaacugguucagaguuccucaacaggugaaauaugcaacaguccucaucagauccuugauggagaaaacugcacacuaauagaugcucuauugggagacccucagugugaugguuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguguacagagaugaagcauuaaacaaccgauuccagaucaagggaguugagcugaagucaggguacaaagauuggauccuauggauuuccuuugccauaucauguuuuuuacuuuguguugcuuuguugggguucaucaugugggccugccaaaaaggcaacauuaggugcaacauuugcauuuga

SEQ ID NO: 42698 - RNA, 1701 nt, Artificial Sequence
  hemagglutinin__InfluenzaA__AHZ40237
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaguacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccacugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugagaaagaauucucagaaguagaagggagaauucaggaccuugagaaauauguugaggacacaaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42699 - RNA, 1701 nt, Artificial Sequence; identical to SEQ ID NO: 40420
  hemagglutinin__InfluenzaA__AHZ40249

SEQ ID NO: 42700 - RNA, 1701 nt, Artificial Sequence; identical to SEQ ID NO: 40362
  hemagglutinin__InfluenzaA__AHZ40261

SEQ ID NO: 42701 - RNA, 1701 nt, Artificial Sequence
  hemagglutinin__InfluenzaA__AHZ40273
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaguacccagcauugaacgugacuaugccaaacaaugaacaauuugacaaauuguacauuugggggguucaccacccggguacggacaaggaccaaaucuuccuguaugcucaaucaucaggaagaaucacaguauccaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugagaaagaauucucagaaguagaagggagaauucaggaccuugagaaauauguugaggacacaaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42702 - RNA, 1701 nt, Artificial Sequence
  hemagglutinin__InfluenzaA__AHZ40285
augaagacuaucauugcuuugagcuacauucuaugucuaguuuucgcccaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucugauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaaucugugaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacaaagugggaaaagcucaauaaugagaucagauacacccauuggaaaaugcaauucugaaugcaucacuccaaauggaagcauucccaaugacaaaccauuccaaaauguaaacaggaucacauacggggccuguccuagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggaaaaccaacauacaauugaucuaacugacucagaaaugaacaaacuguuugaaaaaacaaagaagcaacugagagaaaaugcugaagauaugggcaauggcuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42703 - RNA, 1701 nt, Artificial Sequence; identical to SEQ ID NO: 40647
  hemagglutinin__InfluenzaA__AHZ40297

SEQ ID NO: 42704 - RNA, 1701 nt, Artificial Sequence
  hemagglutinin__InfluenzaA__AHZ40309
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccccagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauuggcugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaaaugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaggguagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaaugcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagauuaagggaguugagcugaagucaggguacaaagauuggauccuauggauuuccuuugccauaucauguuuuuugcuuuguguuguuuuguugggguucaucaugugggccugccaaaagggcaacauuaggugcaacauuugcauuuga

SEQ ID NO: 42705 - RNA, 1701 nt, Artificial Sequence
  hemagglutinin__InfluenzaA__AHZ40321
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggugaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42706 - RNA, 1701 nt, Artificial Sequence
  hemagglutinin__InfluenzaA__AHZ40333
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaguuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42707 - RNA, 1701 nt, Artificial Sequence
  hemagglutinin__InfluenzaA__AHZ40345
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaagugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42708 - RNA, 1701 nt, Artificial Sequence; identical to SEQ ID NO: 40388
  hemagglutinin__InfluenzaA__AHZ40357

SEQ ID NO: 42709 - RNA, 1701 nt, Artificial Sequence
  hemagglutinin__InfluenzaA__AHZ40369
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggagaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaaggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcagagcuucuuguugcccuagagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcacuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42710 - RNA, 1701 nt, Artificial Sequence
  hemagglutinin__InfluenzaA__AHZ40381
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugaacugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcucuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugaguugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42711 - RNA, 1701 nt, Artificial Sequence
  hemagglutinin__InfluenzaA__AHZ40393
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaguuggcaacaggaaugcgaaauguaccagagaaacaaacuagaggcauauuuggcgcaauagcggguuucauagaaaaugguugggagggaaugguggaugguugguacgguuucagacaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42712 - RNA, 1701 nt, Artificial Sequence; identical to SEQ ID NO: 40393
  hemagglutinin__InfluenzaA__AHZ40405

SEQ ID NO: 42713 - RNA, 1701 nt, Artificial Sequence; identical to SEQ ID NO: 40393
  hemagglutinin__InfluenzaA__AHZ40417

SEQ ID NO: 42714 - RNA, 1701 nt, Artificial Sequence
  hemagglutinin__InfluenzaA__AHZ40429
augaagaccaucauugcuuugagcuacauucuaugucuaguuuucgcucaagaacuuccuggaaaugacgacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucgcuaguugccucauccggcacacuggaguuuaaaaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugcuugcauaggaucaaucagaaauggaacuuaugaucacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42715 - RNA, 1701 nt, Artificial Sequence
  hemagglutinin__InfluenzaA__AHZ40441
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuagcagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42716 - RNA, 1701 nt, Artificial Sequence; identical to SEQ ID NO: 40530
  hemagglutinin__InfluenzaA__AHZ40453

SEQ ID NO: 42717 - RNA, 1701 nt, Artificial Sequence
  hemagglutinin__InfluenzaA__AHZ40465
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccgcagugugauggcuuucaaaauaagaaaugggaccuuuuuguugaacgaagcaaagccuacagcaacuguuacccuuaugauaugccggauuaugccucccugaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacgauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaaccggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42718 - RNA, 1701 nt, Artificial Sequence
  hemagglutinin__InfluenzaA__AHZ40477
augaagacuaucauugcuuugagcuacauucuaugucuaguuuucgcccaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucugauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaaucugugaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggaaaaugcaauucugaaugcaucacuccaaauggaagcauucccaaugacaaaccauuccaaaauguaaacaggaucacauacggggccuguccuagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaaggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggaaaaccaacauacaauugauuuaacugacucagaaaugaacaaacuguuugaaaaaacaaagaagcaacugagagaaaaugcugaagauaugggcaauggcuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42719 - RNA, 1701 nt, Artificial Sequence
  hemagglutinin__InfluenzaA__AHZ40489
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucugguucagacaauggaacguguuacccaggagauuucaucgauuaugaggagcuaagagagcaauugagcucagugucaucauuugaaagguuugagauauuccccaaaacaaguucauggccaaaucaugacucgaacaaagguguaacggcagcauguccucaugcuggagcaaaaggcuucuacaaaaauuuaauauggcuaguuaaaaaaggaaauucauacccaaagcucagcauauccuacauuaaugacaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauuugcaauggaaagaaaugcuggaucugguauuaucauuucagauacaccaguucacgauugcaauacgacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugcuggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaacacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugauuacccaaaauacucagaggaagcaaaauuaaacagagaagaaauagaugggguaaagcuggaaucaacaaggauuuaccagauuuuggcgaucuauucaacugccgcuaguucauugguacugguagucucccugggggcaaucaguuuuuggaugugcucuaaugggucucuacaguguagaauauguauuuaa

SEQ ID NO: 42720 - RNA, 1701 nt, Artificial Sequence; identical to SEQ ID NO: 42685
  hemagglutinin__InfluenzaA__AHZ40500

SEQ ID NO: 42721 - RNA, 1701 nt, Artificial Sequence; identical to SEQ ID NO: 40393
  hemagglutinin__InfluenzaA__AHZ40512

SEQ ID NO: 42722 - RNA, 1701 nt, Artificial Sequence
  hemagglutinin__InfluenzaA__AHZ40524
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugagcaauuugacaaauuguacauuugggggguccaccacccagguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaaaucugaauguaucacuccaaauggaagcauucccaaugacaaaccauuccaaaauguaaacaggaucacauacggggccugucccagauauguuaagcaaagcacucugaaauuggcaacaggaaugcgaaauguaccagagagacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42723 - RNA, 1701 nt, Artificial Sequence
  hemagglutinin__InfluenzaA__AHZ40536
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaacguaccagagaaacaaacuagaggcauauuuggcgcaauagcggguuucauagaaaaugguugggagggaaugguagaugguugguacgguuucaggcaucaaaauucugagggaagaggacaagcagcagaucucaaaagcacucaagcagcaaucgaucaaaucaaugggaaacugaaucgauugaucgggaaaaccaacgagaaauuccaucagauugaaaaagaauucucagaaguagaagggagaauucaggaccuugagaaauauguugaggauacuaaaauagaucucuggucauacaaugcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42724 - RNA, 1701 nt, Artificial Sequence
  hemagglutinin__InfluenzaA__AHZ40548
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacccaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42725 - RNA, 1701 nt, Artificial Sequence; identical to SEQ ID NO: 40362
  hemagglutinin__InfluenzaA__AHZ40572

SEQ ID NO: 42726 - RNA, 1701 nt, Artificial Sequence
  hemagglutinin__InfluenzaA__AHZ40583
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugccacugagcugguucagaauuccucaauaggugaaauaugcgacaguccucaucagauccuugauggagaaaacugcacacuaauagaugcucuauugggagacccucagugcgauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcggaauguaccagagaaacaaacuagaggcauauuuggugcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaagaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggcaugccaaaagggcaacauuaggugcaacauuugcauuuga

SEQ ID NO: 42727 - RNA, 1701 nt, Artificial Sequence
  hemagglutinin__InfluenzaA__AHZ40595
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcaugacgggaaacuaugcaaacuaagagggguagccccauugcauuuggguaaauguaacauugcuggcuggauccugggaaauccagagugugaaucacucuccacagcaagcucaugguccuacauuguggaaacaucugguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaggcuucuacaaaaauuuaauauggcuaguuaaaaaaggaaauucauacccaaagcucagcauauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauuugcaaugaaaagaaaugcuggaucugguauuaucauuucagauacaccaguucacgauugcaauacaacuugucagacacccaagggugcuauaaacaccagccucccauuucagaauauacauccaaucacaauuggaaaauguccaaaauauguaaaaagcacaaaauugagacuggccacaggauugaggaaugucccgucuauucaaucuagaggccuauuuggggccauugcuggcuucauugaagggggauggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaagaaauuggaaauggcugcuuugaauuuuaccacaaaugcgauaacacgugcauggaaagugucaaaaaugggacuuaugauuacccaaaauacucagaggaagcaaaauuaaacagagaaaaaauagaugggguaaagcuggaaucaacaaggauuuaccagauuuuggcgaucuauucaacugccgcuaguucauugguacugguagucucccugggggcaaucaguuuuuggaugugcucuaaugggucucuacaguguagaauauguauuuaa

SEQ ID NO: 42728 - RNA, 1701 nt, Artificial Sequence
  hemagglutinin__InfluenzaA__AHZ40606
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuauacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42729 - RNA, 1701 nt, Artificial Sequence; identical to SEQ ID NO: 40393
  hemagglutinin__InfluenzaA__AHZ40618

SEQ ID NO: 42730 - RNA, 1701 nt, Artificial Sequence
  hemagglutinin__InfluenzaA__AHZ40626
augaagaccaucauugcuuugagcuacauucuaugucuaguuuucgcucaagaacuuccuggaaaugacgacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguguacagagaugaagcauuaaacaaccgauuccagaucaagggaauugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42731 - RNA, 1701 nt, Artificial Sequence
  hemagglutinin__InfluenzaA__AHZ40638
augaagacuaucauugcuuugagcuacauucuauguuugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacuaagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42732 - RNA, 1701 nt, Artificial Sequence; identical to SEQ ID NO: 40362
  hemagglutinin__InfluenzaA__AHZ40650

SEQ ID NO: 42733 - RNA, 1701 nt, Artificial Sequence
  hemagglutinin__InfluenzaA__AHZ40662
augaagaccaucauugcuuugagcuacauucuaugucuaguuuucgcucaagaacuuccuggaaaugacgacagcacggcaacgcugugccuugggcaccaugcagugccaaacggaacgauagugaaaacaaucacgaaugaccgaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaaagaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuauaccaaacaaugaacaauuugacaaauuguacauuugggggguucaccacccggguacagacaaggaccaaaucuuccuguaugcucaagcaucaggaagaaucacaguaucuaccaaaagaagccaacaaacuguaauuccgaauaucggaucuagacccagaguaaggaauaucccuagcagaguaagcaucuauuggacaauaguaaaaccaggagacauacuuuugauuaacagcacagggaaucuaauugcuccuagggguuacuucaaaauacgaaguggaaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggugcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42734 - RNA, 1701 nt, Artificial Sequence; identical to SEQ ID NO: 40407
  hemagglutinin__InfluenzaA__AHZ40674

SEQ ID NO: 42735 - RNA, 1701 nt, Artificial Sequence; identical to SEQ ID NO: 40393
  hemagglutinin__InfluenzaA__AHZ40686

SEQ ID NO: 42736 - RNA, 1701 nt, Artificial Sequence; identical to SEQ ID NO: 40372
  hemagglutinin__InfluenzaA__AHZ40698

SEQ ID NO: 42737 - RNA, 1701 nt, Artificial Sequence; identical to SEQ ID NO: 40372
  hemagglutinin__InfluenzaA__AHZ40710

SEQ ID NO: 42738 - RNA, 1701 nt, Artificial Sequence; identical to SEQ ID NO: 41075
  hemagglutinin__InfluenzaA__AHZ40722

SEQ ID NO: 42739 - RNA, 1701 nt, Artificial Sequence
  hemagglutinin__InfluenzaA__AHZ40734
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucaaauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaaacuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccgggcacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacagaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42740 - RNA, 1701 nt, Artificial Sequence
  hemagglutinin__InfluenzaA__AHZ40746
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaaccagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugagaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42741 - RNA, 1701 nt, Artificial Sequence; identical to SEQ ID NO: 42691
  hemagglutinin__InfluenzaA__AHZ40758

SEQ ID NO: 42742 - RNA, 1701 nt, Artificial Sequence; identical to SEQ ID NO: 33171
  hemagglutinin__InfluenzaA__AHZ40782

SEQ ID NO: 42743 - RNA, 1701 nt, Artificial Sequence; identical to SEQ ID NO: 33171
  hemagglutinin__InfluenzaA__AHZ40793

SEQ ID NO: 42744 - RNA, 1701 nt, Artificial Sequence; identical to SEQ ID NO: 33171
  hemagglutinin__InfluenzaA__AHZ40804

SEQ ID NO: 42745 - RNA, 1701 nt, Artificial Sequence
  hemagglutinin__InfluenzaA__AHZ40815
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaccuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucgagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42746 - RNA, 1701 nt, Artificial Sequence
  hemagglutinin__InfluenzaA__AHZ40826
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaccuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaaguaucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42747 - RNA, 1701 nt, Artificial Sequence
  hemagglutinin__InfluenzaA__AHZ40848
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaccuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaagaaggaaauucauacccaaagcucagcaaauccuacauuaaugauaaagggaaagaaguccucgugcuauggggcauucaccauccaucuacuagugcugagcaacaaagucucuaucagaaugcagaugcauauguuuuuguggggucaucaagauacagcaagaaguucaagccggaaauagcagcaagacccaaagugaggggucaagcagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42748 - RNA, 1701 nt, Artificial Sequence
  hemagglutinin__InfluenzaA__AHZ40881
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaccuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugagcaacaaagucucuaucagaaugcagaugcauauguuuuuguggggucaucaagauacagcaagaaguucaagccggaaauagcagcaagacccaaagugaggggucaagcagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42749 - RNA, 1701 nt, Artificial Sequence; identical to SEQ ID NO: 42748
  hemagglutinin__InfluenzaA__AHZ40892

SEQ ID NO: 42750 - RNA, 1701 nt, Artificial Sequence; identical to SEQ ID NO: 42747
  hemagglutinin__InfluenzaA__AHZ40914

SEQ ID NO: 42751 - RNA, 1701 nt, Artificial Sequence; identical to SEQ ID NO: 42748
  hemagglutinin__InfluenzaA__AHZ40925

SEQ ID NO: 42752 - RNA, 1701 nt, Artificial Sequence
  hemagglutinin__InfluenzaA__AHZ40936
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaccuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugagcaacaaagucucuaucagaaugcagaugcauauguuuuuguggggucaucaagauacagcaagaaguucaagccggaaauagcagcaagacccaaagugagggaucaagcagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42753 - RNA, 1701 nt, Artificial Sequence; identical to SEQ ID NO: 42747
  hemagglutinin__InfluenzaA__AHZ40947

SEQ ID NO: 42754 - RNA, 1701 nt, Artificial Sequence; identical to SEQ ID NO: 42748
  hemagglutinin__InfluenzaA__AHZ40958

SEQ ID NO: 42755 - RNA, 1701 nt, Artificial Sequence; identical to SEQ ID NO: 42752
  hemagglutinin__InfluenzaA__AHZ40969

SEQ ID NO: 42756 - RNA, 1701 nt, Artificial Sequence; identical to SEQ ID NO: 42752
  hemagglutinin__InfluenzaA__AHZ40980

SEQ ID NO: 42757 - RNA, 1701 nt, Artificial Sequence; identical to SEQ ID NO: 42752
  hemagglutinin__InfluenzaA__AHZ40991

SEQ ID NO: 42758 - RNA, 1701 nt, Artificial Sequence; identical to SEQ ID NO: 42752
  hemagglutinin__InfluenzaA__AHZ41002

SEQ ID NO: 42759 - RNA, 1701 nt, Artificial Sequence; identical to SEQ ID NO: 42752
  hemagglutinin__InfluenzaA__AHZ41013

SEQ ID NO: 42760 - RNA, 1701 nt, Artificial Sequence; identical to SEQ ID NO: 42748
  hemagglutinin__InfluenzaA__AHZ41024

SEQ ID NO: 42761 - RNA, 1701 nt, Artificial Sequence; identical to SEQ ID NO: 42748
  hemagglutinin__InfluenzaA__AHZ41035

SEQ ID NO: 42762 - RNA, 1701 nt, Artificial Sequence; identical to SEQ ID NO: 42748
  hemagglutinin__InfluenzaA__AHZ41046

SEQ ID NO: 42763 - RNA, 1701 nt, Artificial Sequence; identical to SEQ ID NO: 42748
  hemagglutinin__InfluenzaA__AHZ41057

SEQ ID NO: 42764 - RNA, 1701 nt, Artificial Sequence; identical to SEQ ID NO: 42748
  hemagglutinin__InfluenzaA__AHZ41068

SEQ ID NO: 42765 - RNA, 1701 nt, Artificial Sequence; identical to SEQ ID NO: 42752
  hemagglutinin__InfluenzaA__AHZ41079

SEQ ID NO: 42766 - RNA, 1701 nt, Artificial Sequence; identical to SEQ ID NO: 42748
  hemagglutinin__InfluenzaA__AHZ41090

SEQ ID NO: 42767 - RNA, 1701 nt, Artificial Sequence; identical to SEQ ID NO: 42752
  hemagglutinin__InfluenzaA__AHZ41101

SEQ ID NO: 42768 - RNA, 1701 nt, Artificial Sequence; identical to SEQ ID NO: 42748
  hemagglutinin__InfluenzaA__AHZ41112

SEQ ID NO: 42769 - RNA, 1701 nt, Artificial Sequence; identical to SEQ ID NO: 42748
  hemagglutinin__InfluenzaA__AHZ41123

SEQ ID NO: 42770 - RNA, 1701 nt, Artificial Sequence; identical to SEQ ID NO: 42748
  hemagglutinin__InfluenzaA__AHZ41134

SEQ ID NO: 42771 - RNA, 1701 nt, Artificial Sequence; identical to SEQ ID NO: 42748
  hemagglutinin__InfluenzaA__AHZ41145

SEQ ID NO: 42772 - RNA, 1701 nt, Artificial Sequence; identical to SEQ ID NO: 42748
  hemagglutinin__InfluenzaA__AHZ41156

SEQ ID NO: 42773 - RNA, 1701 nt, Artificial Sequence; identical to SEQ ID NO: 42748
  hemagglutinin__InfluenzaA__AHZ41167

SEQ ID NO: 42774 - RNA, 1701 nt, Artificial Sequence; identical to SEQ ID NO: 42748
  hemagglutinin__InfluenzaA__AHZ41178

SEQ ID NO: 42775 - RNA, 1701 nt, Artificial Sequence; identical to SEQ ID NO: 42748
  hemagglutinin__InfluenzaA__AHZ41189

SEQ ID NO: 42776 - RNA, 1701 nt, Artificial Sequence; identical to SEQ ID NO: 42747
  hemagglutinin__InfluenzaA__AHZ41246

SEQ ID NO: 42777 - RNA, 1701 nt, Artificial Sequence; identical to SEQ ID NO: 42752
  hemagglutinin__InfluenzaA__AHZ41263

SEQ ID NO: 42778 - RNA, 1701 nt, Artificial Sequence; identical to SEQ ID NO: 42748
  hemagglutinin__InfluenzaA__AHZ41281

SEQ ID NO: 42779 - RNA, 1701 nt, Artificial Sequence; identical to SEQ ID NO: 42748
  hemagglutinin__InfluenzaA__AHZ41292

SEQ ID NO: 42780 - RNA, 1701 nt, Artificial Sequence; identical to SEQ ID NO: 42747
  hemagglutinin__InfluenzaA__AHZ41303

SEQ ID NO: 42781 - RNA, 1701 nt, Artificial Sequence; identical to SEQ ID NO: 42747
  hemagglutinin__InfluenzaA__AHZ41314

SEQ ID NO: 42782 - RNA, 1701 nt, Artificial Sequence; identical to SEQ ID NO: 42747
  hemagglutinin__InfluenzaA__AHZ41325

SEQ ID NO: 42783 - RNA, 1701 nt, Artificial Sequence; identical to SEQ ID NO: 42747
  hemagglutinin__InfluenzaA__AHZ41336

SEQ ID NO: 42784 - RNA, 1701 nt, Artificial Sequence; identical to SEQ ID NO: 42747
  hemagglutinin__InfluenzaA__AHZ41347

SEQ ID NO: 42785 - RNA, 1701 nt, Artificial Sequence; identical to SEQ ID NO: 42748
  hemagglutinin__InfluenzaA__AHZ41358

SEQ ID NO: 42786 - RNA, 1701 nt, Artificial Sequence; identical to SEQ ID NO: 42748
  hemagglutinin__InfluenzaA__AHZ41366

SEQ ID NO: 42787 - RNA, 1701 nt, Artificial Sequence; identical to SEQ ID NO: 42752
  hemagglutinin__InfluenzaA__AHZ41377

SEQ ID NO: 42788 - RNA, 1701 nt, Artificial Sequence; identical to SEQ ID NO: 42748
  hemagglutinin__InfluenzaA__AHZ41388

SEQ ID NO: 42789 - RNA, 1701 nt, Artificial Sequence; identical to SEQ ID NO: 42752
  hemagglutinin__InfluenzaA__AHZ41410

SEQ ID NO: 42790 - RNA, 1701 nt, Artificial Sequence; identical to SEQ ID NO: 42748
  hemagglutinin__InfluenzaA__AHZ41432

SEQ ID NO: 42791 - RNA, 1701 nt, Artificial Sequence
  hemagglutinin__InfluenzaA__AHZ41441
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaccuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaagaaggaaauucauacccaaagcucagcaaauccuacauuaaugauaaagggaaagaaguccucgugcuauggggcauucaccauccaucuacuagugcugagcaacaaagucucuaucagaaugcagaugcauauguuuuuguggggucaucaagauacagcaagaaguucaagccggaaauagcagcaagacccaaagugagggaucaagcagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42792 - RNA, 1701 nt, Artificial Sequence; identical to SEQ ID NO: 42747
  hemagglutinin__InfluenzaA__AHZ41452

SEQ ID NO: 42793 - RNA, 1701 nt, Artificial Sequence
  hemagglutinin__InfluenzaA__AHZ41463
augaaggcaauacuaguaguucugcuauauacauuugcaaccgcaaaugcagacacauuauguauagguuaucaugcgaacaauucaacagacacuguauacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaccuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugagcaacaaagucucuaucagaaugcagaugcauauguuuuuguggggucaucaagauacagcaagaaguucaagccggaaauagcagcaagacccaaagugaggggucaagcagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42794 - RNA, 1701 nt, Artificial Sequence; identical to SEQ ID NO: 42747
  hemagglutinin__InfluenzaA__AHZ41473

SEQ ID NO: 42795 - RNA, 1701 nt, Artificial Sequence; identical to SEQ ID NO: 42747
  hemagglutinin__InfluenzaA__AHZ41484

SEQ ID NO: 42796 - RNA, 1701 nt, Artificial Sequence; identical to SEQ ID NO: 42752
  hemagglutinin__InfluenzaA__AHZ41495

SEQ ID NO: 42797 - RNA, 1701 nt, Artificial Sequence; identical to SEQ ID NO: 42747
  hemagglutinin__InfluenzaA__AHZ41506

SEQ ID NO: 42798 - RNA, 1701 nt, Artificial Sequence
  hemagglutinin__InfluenzaA__AHZ41517
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaccuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcgaauccuacauuaaugauaaagggaaagaaguccucgugcuauggggcauucaccauccaucuacuagugcugagcaacaaagucucuaucagaaugcagaugcauauguuuuuguggggucaucaagauacagcaagaaguucaagccggaaauagcagcaagacccaaagugaggggucaagcagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42799 - RNA, 1701 nt, Artificial Sequence
  hemagglutinin__InfluenzaA__AHZ41528
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaccuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcgaauccuacauuaaugauaaagggaaagaaguccucgugcuauggggcauucaccauccaucuacuagugcugaucaacaaagucucuaucagaaugcagaugcauauguuuuuguggggucaucaagauacagcaagaaguucaagccggaaauagcagcaagacccaaagugaggggucaagcagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42800 - RNA, 1701 nt, Artificial Sequence; identical to SEQ ID NO: 42752
  hemagglutinin__InfluenzaA__AHZ41539

SEQ ID NO: 42801 - RNA, 1701 nt, Artificial Sequence
  hemagglutinin__InfluenzaA__AHZ41550
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaccuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaagaaggaaauucauacccaaagcucagcaaauccuacauuaaugauaaagggaaagaaguccucgugcuauggggcauucaccauccaucuacuagugcugagcaacaaagucucuaucagaaugcagaugcauauguuuuuguggggucaucaagauacagcaagaaguucaagccggaaauagcagcaagacccaaagugaggggucaagcagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42802 - RNA, 1701 nt, Artificial Sequence; identical to SEQ ID NO: 42748
  hemagglutinin__InfluenzaA__AHZ41561

SEQ ID NO: 42803 - RNA, 1701 nt, Artificial Sequence
  hemagglutinin__InfluenzaA__AHZ41572
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaccuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugagcaacaaagucucuaucagaaugcagaugcauauguuuuuguggggucaucaagauacagcaagaaguucaagccggaaauagcagcaagacccaaagugaggggucaagcagggagaaugaacuauuacuggacacuaguagagccgggagacgaaauaacauucgaagcaacuggaaaucuagugguaccgagauaugcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42804 - RNA, 1701 nt, Artificial Sequence; identical to SEQ ID NO: 42752
  hemagglutinin__InfluenzaA__AHZ41583

SEQ ID NO: 42805 - RNA, 1701 nt, Artificial Sequence; identical to SEQ ID NO: 42747
  hemagglutinin__InfluenzaA__AHZ41594

SEQ ID NO: 42806 - RNA, 1701 nt, Artificial Sequence
  hemagglutinin__InfluenzaA__AHZ41605
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaccuaguucagacaauggaacguguuacccaggagauuucaucgauuaugaggagcuaagagagcaauugagcucagugucaucauuugaaagguuugagauauuccccaauacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugagcaacaaagucucuaucagaaugcagaugcauauguuuuuguggggucaucaagauacagcaagaaguucaagccggaaauagcagcaagacccaaagugaugggucaagcagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42807 - RNA, 1701 nt, Artificial Sequence; identical to SEQ ID NO: 42747
  hemagglutinin__InfluenzaA__AHZ41616

SEQ ID NO: 42808 - RNA, 1701 nt, Artificial Sequence; identical to SEQ ID NO: 42752
  hemagglutinin__InfluenzaA__AHZ41627

SEQ ID NO: 42809 - RNA, 1701 nt, Artificial Sequence; identical to SEQ ID NO: 42752
  hemagglutinin__InfluenzaA__AHZ41638

SEQ ID NO: 42810 - RNA, 1701 nt, Artificial Sequence; identical to SEQ ID NO: 42748
  hemagglutinin__InfluenzaA__AHZ41649

SEQ ID NO: 42811 - RNA, 1701 nt, Artificial Sequence; identical to SEQ ID NO: 42748
  hemagglutinin__InfluenzaA__AHZ41660

SEQ ID NO: 42812 - RNA, 1701 nt, Artificial Sequence; identical to SEQ ID NO: 42752
  hemagglutinin__InfluenzaA__AHZ41671

SEQ ID NO: 42813 - RNA, 1701 nt, Artificial Sequence; identical to SEQ ID NO: 42752
  hemagglutinin__InfluenzaA__AHZ41682

SEQ ID NO: 42814 - RNA, 1701 nt, Artificial Sequence; identical to SEQ ID NO: 42752
  hemagglutinin__InfluenzaA__AHZ41693

SEQ ID NO: 42815 - RNA, 1701 nt, Artificial Sequence; identical to SEQ ID NO: 42752
  hemagglutinin__InfluenzaA__AHZ41704

SEQ ID NO: 42816 - RNA, 1701 nt, Artificial Sequence; identical to SEQ ID NO: 42752
  hemagglutinin__InfluenzaA__AHZ41715

SEQ ID NO: 42817 - RNA, 1701 nt, Artificial Sequence; identical to SEQ ID NO: 42752
  hemagglutinin__InfluenzaA__AHZ41726

SEQ ID NO: 42818 - RNA, 1701 nt, Artificial Sequence; identical to SEQ ID NO: 42752
  hemagglutinin__InfluenzaA__AHZ41737

SEQ ID NO: 42819 - RNA, 1701 nt, Artificial Sequence; identical to SEQ ID NO: 42752
  hemagglutinin__InfluenzaA__AHZ41748

SEQ ID NO: 42820 - RNA, 1701 nt, Artificial Sequence; identical to SEQ ID NO: 42752
  hemagglutinin__InfluenzaA__AHZ41759

SEQ ID NO: 42821 - RNA, 1701 nt, Artificial Sequence; identical to SEQ ID NO: 40579
  hemagglutinin__InfluenzaA__AHZ42561

SEQ ID NO: 42822 - RNA, 1701 nt, Artificial Sequence
  hemagglutinin__InfluenzaA__AHZ42572
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaauggacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42823 - RNA, 1701 nt, Artificial Sequence
  hemagglutinin__InfluenzaA__AHZ42584
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42824 - RNA, 1701 nt, Artificial Sequence
  hemagglutinin__InfluenzaA__AHZ42596
augaagacuaucauugcuuugagcuacauucuaugucuaguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcagagcacucugaaguuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42825 - RNA, 1701 nt, Artificial Sequence; identical to SEQ ID NO: 42719
  hemagglutinin__InfluenzaA__AHZ42608

SEQ ID NO: 42826 - RNA, 1701 nt, Artificial Sequence
  hemagglutinin__InfluenzaA__AHZ42619
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuacugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42827 - RNA, 1701 nt, Artificial Sequence
  hemagglutinin__InfluenzaA__AHZ42631
augaagacuaucauugcuuugagcuacauucuaugucugguuuucgcucaaaaacuuccuggaaauuacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagacgcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42828 - RNA, 1701 nt, Artificial Sequence
  hemagglutinin__InfluenzaA__AHZ42643
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucugguucagacaauggaacguguuacccaggagauuucaucgauuaugaggagcuaagagagcaauugagcucagugucaucauuugaaagguuugagauauuccccaaagcaaguucauggcccaaucaugauucgaacaaagguguaacggcagcauguccucaugcuggagcaaaaggcuucuacaaaaauuuaauauggcuaguuaaaaaaggaaauucauacccaaagcucagcauauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauuugcaauggaaagaaaugcuggaucugguauuaucauuucagauacaccaguucacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugcuggcuucauugaagggggauggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaaggacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugauuacccaaaauacucagaggaagcaaaauuaaacagagaaaaaauagaugggguaaagcuggaaucaacaaggauuuaccagauuuuggcgaucuauucaacugccgcuaguucauugguacugguagucucccugggggcaaucaguuuuuggaugugcucuaaugggucucuacaguguagaauauguauuuaa

SEQ ID NO: 42829 - RNA, 1701 nt, Artificial Sequence
  hemagglutinin__InfluenzaA__AHZ42654
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaacgaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaacguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42830 - RNA, 1701 nt, Artificial Sequence; identical to SEQ ID NO: 42726
  hemagglutinin__InfluenzaA__AHZ42666

SEQ ID NO: 42831 - RNA, 1701 nt, Artificial Sequence
  hemagglutinin__InfluenzaA__AHZ42678
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacuaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42832 - RNA, 1701 nt, Artificial Sequence
  hemagglutinin__InfluenzaA__AHZ42690
augaaggcaauacuaguaguucugcuauacacauaugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacuacugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaauagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggggcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgcuaguucauugguacugguagucucccugggggcaaucaguuucuggaugugcucuaaugggucucuacaguguagaauauguauuuaa

SEQ ID NO: 42833 - RNA, 1701 nt, Artificial Sequence; identical to SEQ ID NO: 42724
  hemagglutinin__InfluenzaA__AHZ42701

SEQ ID NO: 42834 - RNA, 1701 nt, Artificial Sequence
  hemagglutinin__InfluenzaA__AHZ42713
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacagacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugccccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42835 - RNA, 1701 nt, Artificial Sequence
  hemagglutinin__InfluenzaA__AHZ42725
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaaaugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42836 - RNA, 1701 nt, Artificial Sequence
  hemagglutinin__InfluenzaA__AHZ42737
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaaugggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaagggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaauagagccgggagacaaaauaacauucgaagcaacuggaaaucuagugguaccgagauaugcauucgcaauggagagaaaugcugaaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauuaagacuggccacaggauugaggaaugucccgucuauucaaucuagaggccuauucggggccauugccggcuucauugaagggggguggacagggaugguagauggaugguacgguuaucaccaucaaaaugagcagggaucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggauguguucuaaugggucucuacaguguagaauauguauuuaa

SEQ ID NO: 42837 - RNA, 1701 nt, Artificial Sequence; identical to SEQ ID NO: 40391
  hemagglutinin__InfluenzaA__AHZ42748

SEQ ID NO: 42838 - RNA, 1701 nt, Artificial Sequence; identical to SEQ ID NO: 40407
  hemagglutinin__InfluenzaA__AHZ42760

SEQ ID NO: 42839 - RNA, 1701 nt, Artificial Sequence
  hemagglutinin__InfluenzaA__AHZ42772
augaagaccaucauugcuuugagcuacauucuaugucuaguuuucgcucaagaacuuccuggaaaugacgacagcacggcaacgcugugccuugggcaccaugcagugccaaacggaacgauagugaaaacaaucacgaaugaccgaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaaagaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaaacuguaauuccgaauaucggaucuagacccagaguaaggaauaucccuagcagaguaagcaucuauuggacaauaguaaaaccaggagacauacuuuugauuaacagcacagggaaucuaauugcuccuagggguuacuucaaaauacgaaguggaaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggugcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguguacagagaugaagcauuaaacaaccgauuccagaucaaggaaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42840 - RNA, 1701 nt, Artificial Sequence; identical to SEQ ID NO: 40393
  hemagglutinin__InfluenzaA__AHZ42784

SEQ ID NO: 42841 - RNA, 1701 nt, Artificial Sequence
  hemagglutinin__InfluenzaA__AHZ42796
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaauuuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaggaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42842 - RNA, 1701 nt, Artificial Sequence
  hemagglutinin__InfluenzaA__AHZ42808
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaauuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuuggggaguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42843 - RNA, 1701 nt, Artificial Sequence
  hemagglutinin__InfluenzaA__AHZ42820
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaagggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaauagagccgggagacaaaauaacauucgaagcaacuggaaaucuagugguaccgagauaugcauucgcaauggagagaaaugcugaaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauuaagacuggccacaggauugaggaaugucccgucuauucaaucuagaggccuauucggggccauugccggcuucauugaagggggguggacagggaugguagauggaugguacgguuaucaccaucaaaaugagcagggaucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42844 - RNA, 1701 nt, Artificial Sequence
  hemagglutinin__InfluenzaA__AHZ42831
augaagacuaucauugcuuugagcuacauucuaugucuaguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacucaaacuucaaauacccagcauugaacgugacuaugccaaacaaugaacaauuugacaaauuguacauuugggggguucaccauccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaacggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggugcaauagcggguuucauagaaaaugguugggagggaaugauggaugguugguacgguuucaggcaccaaaauucugagggaagaggacaagcagcagaucucaaaagcacucaagcagcaaucgaucaaaucaaugggaagcugaaucgauugaucgggaaaaccaacgagaaauuccaucagauugaaaaagaauuuucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42845 - RNA, 1701 nt, Artificial Sequence
  hemagglutinin__InfluenzaA__AHZ42843
augaagacuaucauugcuuugagcuacauucuaugucugguuuucgcucaaaaacuuccuggaaaugacaauagcacggcaacgcugugccuugggcaccaugcaguaccaaacggaacgauggugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42846 - RNA, 1701 nt, Artificial Sequence
  hemagglutinin__InfluenzaA__AHZ42855
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacaugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42847 - RNA, 1701 nt, Artificial Sequence
  hemagglutinin__InfluenzaA__AHZ42867
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucaucaggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaguacccagcauugaacgugaccaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugagaaagaauucucagaaguagaagggagaauucaggaccuugagaaauauguugaggacacaaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucagaguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42848 - RNA, 1701 nt, Artificial Sequence
  hemagglutinin__InfluenzaA__AHZ42879
augaagacuaucauugcuuugagcuacauucuaugucugguuuucgcucaaaaacuuccuggaaaugacaauagcacggcaacacugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42849 - RNA, 1701 nt, Artificial Sequence
  hemagglutinin__InfluenzaA__AHZ42891
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcagcuguuacccuuaugaugugccggauuaugccucccuuaggucacuaguugccucauccggcacacuggaguuuaacaaugaaagcuucaauugggcuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaaaaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaucgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42850 - RNA, 1701 nt, Artificial Sequence
  hemagglutinin__InfluenzaA__AHZ42903
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugccccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42851 - RNA, 1701 nt, Artificial Sequence; identical to SEQ ID NO: 40592
  hemagglutinin__InfluenzaA__AHZ42915

SEQ ID NO: 42852 - RNA, 1683 nt, Artificial Sequence; identical to SEQ ID NO: 40492
  hemagglutinin__InfluenzaA__AHZ59747

SEQ ID NO: 42853 - RNA, 1683 nt, Artificial Sequence
  hemagglutinin__InfluenzaA__AHZ59759
augaacacucaaauccugguauucgcucugauugcgaucauuccaacaaaugcagacaaaaucugccucggacaucaugccgugucaaacggaaccaaaguaaacacauuaacugaaagaggaguggaagucgucaaugcaacugaaacaguggaacgaacaaacauccccaggaucugcucaaaagggaaaaggacaguugaccucggucaauguggacuccuggggacaaucacuggaccaccucaaugugaccaauuccuagaauuuucagccgauuuaauuauugagaggcgagaaggaagugaugucuguuauccugggaaauucgugaaugaagaagcucugaggcaaauucucagagaaucaggcggaauugacaaggaagcaaugggauucacauacaguggaauaagaacuaauggagcaaccagugcauguaggagaucaggaucuucauucuaugcagaaaugaaauggcuccugucaaacacagauaaugcugcauucccgcagaugacuaagucauauaaaaauacaagaaaaagcccagcucuaauaguaugggggauccaucauuccguaucaacugcagagcaaaccaagcuauaugggaguggaaacaaacuggugacaguugggaguucuaauuaucaacaaucuuuuguaccgaguccaggagcgagaccacaaguuaauggucuaucuggaagaauugacuuucauuggcuaaugcuaaaucccaaugauacagucacuuucaguuucaauggggcuuucauagcuccagaccgugcaagcuuccugagaggaaaaucuaugggaauccagaguggaguacagguugaugccaauugugaaggggacugcuaucauaguggagggacaauaauaaguaacuugccauuucagaacauagauagcagggcaguuggaaaauguccgagauauguuaagcaaaggagucugcugcuagcaacagggaugaagaauguuccugagauuccaaagggaagaggccuauuuggugcuauagcggguuucauugaaaauggaugggaaggccuaauugaugguugguaugguuucagacaccagaaugcacagggagagggaacugcugcagauuacaaaagcacucaaucggcaauugaucaaauaacaggaaaauuaaaccggcuuauagaaaaaaccaaccaacaauuugaguugauagacaaugaauucaaugagguagagaagcaaaucgguaaugugauaaauuggaccagagauucuauaacagaaguguggucauacaaugcugaacucuugguagcaauggagaaccagcauacaauugaucuggcugauucagaaauggacaaacuguacgaacgagugaaaagacagcugagagagaaugcugaagaagauggcacugguugcuuugaaauauuucacaagugugaugaugacuguauggccaguauuagaaauaacaccuaugaucacagcaaaagcagggaagaggcaaugcaaaauagaauacagauugacccagucaaacuaagcagcggcuacaaagaugugauacuuugguuuagcuucggggcaucauguuucauacuucuagccauuguaaugggccuugucuucauauguguaaagaauggaaacaugcggugcacuauuuguauauaa

SEQ ID NO: 42854 - RNA, 1683 nt, Artificial Sequence
  hemagglutinin__InfluenzaA__AHZ59771
augaacacucaaauccugguauucgcucugauugcgaucauuccaacaaaugcagacaaaaucugccucggacaucaugccgugucaaacggaaccaaaguaaacacauuaacugaaagaggaguggaagucgucaaugcaacugaaacaguggaacgaacaaacauccccaggaucugcucaaaagggaaaaggacaguugaccucggucaauguggacuccuggggacaaucacuggaccaccucaaugugaccaauuccuagaauuuucagccgauuuaauuauugagaggcgagaaggaagugaugucuguuauccugggaaauucgugaaugaagaagcucugaggcaaauucucagagaaucaggcggaauugacaaggaagcaaugggauucacauacaguggaauaagaacuaauggagcaaccagugcauguaggagaucaggaucuucauucuaugcagaaaugaaauggcuccugucaaacacagauaaugcugcauucccgcagaugacuaagucauauaaaaauacaagaaaaagcccagcucuaauaguaugggggauccaucauuccguaucaacugcagagcaaaccaagcuauaugggaguggaaacaaacuggugacaguugggaguucuaauuaucaacaaucuuuuguaccgaguccaggagcgagaccacaaguuaauggucaaucuggaagaauugacuuucauuggcuaaugcuaaaucccaaugauacagucacuuucaguuucaauggggcuuucauagcuccagaccgugcaagcuuccugagaggaaaaucuaugggaauccagaguggaguacagguugaugccaauugugaaggggacugcuaucauaguggagggacaauaauaaguaacuugccauuucagaacauagauagcagggcaguuggaaaauguccgagauauguuaagcaaaggagucugcugcuagcaacagggaugaagaauguuccugagauuccaaagggaagaggccuauuuggugcuauagcggguuucauugaaaauggaugggaaggccuaauugaugguugguaugguuucagacaccagaaugcacagggagagggaacugcugcagauuacaaaagcacucaaucggcaauugaucaaauaacaggaaaauuaaaccggcuuauagaaaaaaccaaccaacaauuugaguugauagacaaugaauucaaugagguagagaagcaaaucgguaaugugauaaauuggaccagagauucuauaacagaaguguggucauacaaugcugaacucuugguagcaauggagaaccagcauacaauugaucuggcugauucagaaauggacaaacuguacgaacgagugaaaagacagcugagagagaaugcugaagaagauggcacugguugcuuugaaauauuucacaagugugaugaugacuguauggccaguauuagaaauaacaccuaugaucacagcaaauacagggaagaggcaaugcaaaauagaauacagauugacccagucaaacuaagcagcggcuacaaagaugugauacuuugguuuagcuucggggcaucauguuucauacuucuagccauuguaaugggccuugucuucauauguguaaagaauggaaacaugcggugcacuauuuguauauaa

SEQ ID NO: 42855 - RNA, 1683 nt, Artificial Sequence
  hemagglutinin__InfluenzaA__AHZ59795
augaacacucaaauccugguauucgcucugauugcgaucauuccaacaaaugcagacaaaaucugccucggacaucaugccgugucaaacggaacuaaaguaaacacauuaacugaaagaggaguggaagucgucaaugcaacugaaacaguggaacgaacaaacauccccaggaucugcucaaaagggaaaaggacaguugaccucggucaauguggacuccuggggacaaucacuggaccaccucaaugugaccaauuccuagaauuuucagccgauuuaauuauugagaggcgagaaggaagugaugucuguuauccugggaaauucgugaaugaagaagcucugaggcaaauucucagagaaucaggcggaauugacaaggaagcaaugggauucacauacaguggaauaagaacuaauggaacaaccagugcauguaggagaucaggaucuucauucuaugcagaaaugaaauggcuccugucaaacacagauaaugcugcauucccgcagaugacuaagucauauaaaaauacaagaaaaagcccagcucuaauaguaugggggauccaucauuccguaucaacugcagagcaaaccaagcuauaugggaguggaaacaaacuggugacaguugggaguucuaauuaucaacaaucuuuuguaccgaguccaggagcgagaccacaaguuaauggucuaucuggaagaauugacuuucauuggcuaaugcuaaaucccaaugauacagucacuuucaguuucaauggggcuuucauagcuccagaccgugcaagcuuccugagaggaaaaucuaugggaauccagaguggaguacagguugaugccaauugugaaggggacugcuaucauaguggagggacaauaauaaguaacuugccauuucagaacauagauagcagggcaguuggaaaauguccgagauauguuaagcaaaggagucugcugcuagcaacagggaugaagaauguuccugagauuccaaagggaagaggccuauuuggugcuauagcggguuucauugaaaauggaugggaaggccuaauugaugguugguaugguuucagacaccagaaugcacagggagagggaacugcugcagauuacaaaagcacucaaucggcaauugaucaaauaacaggaaaauuaaaccggcuuauagaaaaaaccaaccaacaauuugaguugauagacaaugaauucaaugagguagagaagcaaaucgguaaugugauaaauuggaccagagauucuauaacagaaguguggucauacaaugcugaacucuugguagcaauggagaaccagcauacaauugaucuggcugauucagaaauggacaaacuguacgaacgagugaaaagacagcugagagagaaugcugaagaagauggcacugguugcuuugaaauauuucacaagugugaugaugacuguauggccaguauuagaaauaacaccuaugaucacagcaaauacagggaagaggcaaugcaaaauagaauacagauugacccagucaaacuaaguagcggcuacaaagaugugauacuuugguuuagcuucggggcaucauguuucauacuucuagccauuguaaugggccuugucuucauauguguaaagaauggaaacaugcggugcacuauuuguauauaa

SEQ ID NO: 42856 - RNA, 1683 nt, Artificial Sequence
  hemagglutinin__InfluenzaA__AHZ59807
augaacacucaaauccugguauucgcucugauugcgaucauuccaacaaaugcagacaaaaucugccucggacaucaugccgugucaaacggaaccaaaguaaacacauuaacugaaagaggaguggaagucgucaaugcaacugaaacaguggaacgaacaaacauccccaggaucugcucaaaagggaaaaggacaguugaccucggucaauguggacuccuggggacaaucacuggaccaccucaaugugaccaauuccuagaauuuucagccgauuuaauuauugagaggcgagaaggaagugaugucuguuauccugggaaauucgugaaugaagaagcucugaggcaaauucucagagaaucaggcggaauugacaaggaagcaaugggauucacauacaguggaauaagaacuaauggaacaaccagugcauguaggagaucaggaucuucauucuaugcagaaaugaaauggcuccugucaaacacagauaaugcugcauucccgcagaugacuaagucauauaaaaauacaagaaaaagcccagcucuaauaguaugggggauccaucauuccguaucaacugcagagcaaaccaagcuauaugggaguggaaacaaacuggugacaguugggaguucuaauuaucaacaaucuuuuguaccgaguccaggagcgagaccacaaguuaauggucuaucuggaagaauugacuuucauuggcuaaugcuaaaucccaaugauacagucacuuucaguuucaauggggcuuucauagcuccagaccgugcaagcuuccugagaggaaaaucuaugggaauccagaguggaguacagguugaugccaauugugaaggggacugcuaucauaguggagggacaauaauaaguaacuugccauuucagaacauagauagcagggcaguuggaaaauguccgagauauguuaagcaaaggagucugcugcuagcaacagggaugaagaauguuccugagauuccaaagggaagaggccuauuuggugcuauagcggguuucauugaaaauggaugggaaggccuaauugaugguugguaugguuucagacaccagaaugcacagggagagggaacugcugcagauuacaaaagcacucaaucggcaauugaucaaauaacaggaaaauuaaaccggcuuauagaaaaaaccaaccaacaauuugaguugauagacaaugaauucaaugagguagagaagcaaaucgguaaugugauaaauuggaccagagauucuauaacagaaguguggucauacaaugcugaacucuugguagcaauggagaaccagcauacaauugaucuggcugauucagaaauggacaaacuguacgaacgagugaaaagacagcugagagagaaugcugaagaagauggcacugguugcuuugaaauauuucacaagugugaugaugacuguauggccaguauuagaaauaacaccuaugaucacagcaaauacagggaagaggcaaugcaaaauagaauacagauugacccagucaaacuaagcagcggcuacaaagaugugauacuuugguuuagcuucggggcaucauguuucauacuucuagccauuguaaugggccuugucuucauauguguaaagaauggaaacaugcggugcacuauuuguauauaa

SEQ ID NO: 42857 - RNA, 1683 nt, Artificial Sequence; identical to SEQ ID NO: 42856
  hemagglutinin__InfluenzaA__AHZ59819

SEQ ID NO: 42858 - RNA, 1683 nt, Artificial Sequence; identical to SEQ ID NO: 40492
  hemagglutinin__InfluenzaA__AHZ59831

SEQ ID NO: 42859 - RNA, 1683 nt, Artificial Sequence; identical to SEQ ID NO: 40492
  hemagglutinin__InfluenzaA__AHZ59843

SEQ ID NO: 42860 - RNA, 1683 nt, Artificial Sequence; identical to SEQ ID NO: 40492
  hemagglutinin__InfluenzaA__AHZ59855

SEQ ID NO: 42861 - RNA, 1683 nt, Artificial Sequence; identical to SEQ ID NO: 42854
  hemagglutinin__InfluenzaA__AHZ59867

SEQ ID NO: 42862 - RNA, 1683 nt, Artificial Sequence; identical to SEQ ID NO: 40492
  hemagglutinin__InfluenzaA__AHZ59879

SEQ ID NO: 42863 - RNA, 1683 nt, Artificial Sequence; identical to SEQ ID NO: 42854
  hemagglutinin__InfluenzaA__AHZ59915

SEQ ID NO: 42864 - RNA, 1683 nt, Artificial Sequence; identical to SEQ ID NO: 40492
  hemagglutinin__InfluenzaA__AHZ59927

SEQ ID NO: 42865 - RNA, 1683 nt, Artificial Sequence; identical to SEQ ID NO: 42854
  hemagglutinin__InfluenzaA__AHZ59939

SEQ ID NO: 42866 - RNA, 1683 nt, Artificial Sequence; identical to SEQ ID NO: 40492
  hemagglutinin__InfluenzaA__AHZ59951

SEQ ID NO: 42867 - RNA, 1683 nt, Artificial Sequence; identical to SEQ ID NO: 40492
  hemagglutinin__InfluenzaA__AHZ59963

SEQ ID NO: 42868 - RNA, 1683 nt, Artificial Sequence; identical to SEQ ID NO: 40492
  hemagglutinin__InfluenzaA__AHZ59988

SEQ ID NO: 42869 - RNA, 1683 nt, Artificial Sequence; identical to SEQ ID NO: 40492
  hemagglutinin__InfluenzaA__AHZ60000

SEQ ID NO: 42870 - RNA, 1683 nt, Artificial Sequence; identical to SEQ ID NO: 40492
  hemagglutinin__InfluenzaA__AHZ60012

SEQ ID NO: 42871 - RNA, 1683 nt, Artificial Sequence; identical to SEQ ID NO: 40492
  hemagglutinin__InfluenzaA__AHZ60024

SEQ ID NO: 42872 - RNA, 1683 nt, Artificial Sequence; identical to SEQ ID NO: 42855
  hemagglutinin__InfluenzaA__AHZ60036

SEQ ID NO: 42873 - RNA, 1683 nt, Artificial Sequence; identical to SEQ ID NO: 42855
  hemagglutinin__InfluenzaA__AHZ60048

SEQ ID NO: 42874 - RNA, 1683 nt, Artificial Sequence
  hemagglutinin__InfluenzaA__AHZ60060
augaacacucaaauccugguauucgcucugauugcgaucauuccaacaaaugcagacaaaaucugccucggacaucaugccgugucaaacggaacuaaaguaaacacauuaacugaaagaggaguggaagucgucaaugcaacugaaacaguggaacgaacaaacauccccaggaucugcucaaaagggaaaaggacaguugaccucggucaauguggacuccuggggacaaucacuggaccaccucaaugugaccaauuccuagaauuuucagccgauuuaauuauugagaggcgagaaggaagugaugucuguuauccugggaaauucgugaaugaagaagcucugaggcaaauucucagagaaucaggcggaauugacaaggaagcaaugggauucacauacaguggaauaagaacuaauggaacaaccagugcauguaggagaucaggaucuucauucuaugcagaaaugaaauggcuccugucaaacacagauaaugcugcauucccgcagaugacuaagucauauaaaaauacaagaaaaagcccagcucuaauaguaugggggauccaucauuccguaucaacugcagagcaaaccaagcuauaugggaguggaaacaaacuggugacaguugggaguucuaauuaucaacaaucuuuuguaccgaguccaggagcgagaccacaaguuaauggucuaucuggaagaauugacuuucauuggcuaaugcuaaaucccaaugauacagucacuuucaguuucaauggggcuuucauagcuccagaccgugcaagcuuccugagaggaaaaucuaugggaauccagaguggaguacagguugaugccaauugugaaggggacugcuaucauaguggagggacaauaauaaguaacuugccauuucagaacauagauagcagggcaguuggaaaauguccgagauauguuaagcaaaggagucugcugcuagcaacagggaugaagaauguuccugagauuccaaagggaagaggccuauuuggugcuauagcggguuucauugaaaauggaugggaaggccuaauugaugguugguaugguuucagacaccagaaugcacagggagagggaacugcugcagauuacaaaagcacucaaucggcaauugaucaaauaacaggaaaauuaaaccggcuuauagaaaaaaccaaccaacaauuugaguugauagacaaugaauucaaugagguagagaagcaaaucgguaaugugauaaauuggaccagagauucuauaacagaaguguggucauacaaugcugaacucuugguagcaauggagaaccagcauacaauugaucuggcugauucagaaauggacaaacuguacgaacgagugaaaagacagcugagagagaaugcugaagaagauggcacugguugcuuugaaauauuucacaagugugaugaugacuguauggccaguauuagaaauaacaccuaugaucacagcaaauacagggaagaggcaaugcaaaauagaauacagauugacccagucaaacuaagcagcggcuacaaagaugugauacuuugguuuagcuucggggcaucauguuucauacuucuagccauuguaaugggccuugucuucauauguguaaagaauggaaacaugcggugcacuauuuguauauaa

SEQ ID NO: 42875 - RNA, 1683 nt, Artificial Sequence; identical to SEQ ID NO: 42855
  hemagglutinin__InfluenzaA__AHZ60072

SEQ ID NO: 42876 - RNA, 1683 nt, Artificial Sequence; identical to SEQ ID NO: 42855
  hemagglutinin__InfluenzaA__AHZ60084

SEQ ID NO: 42877 - RNA, 1683 nt, Artificial Sequence
  hemagglutinin__InfluenzaA__AHZ60096
augaacacucaaauccugguauucgcucugauugcgaucauuccaacaaaugcagacaaaaucugccucggacaucaugccgugucaaacggaaccaaaguaaacacauuaacugaaagaggaguggaagucgucaaugcaacugaaacaguggaacgaacaaacauccccaggaucugcucaaaagggaaaaggacaguugaccucggucaauguggacuccuggggacaaucacuggaccaccucaaugugaccaauuccuagaauuuucagccgauuuaauuauugagaggcgagaaggaagugaugucuguuauccugggaaauucgugaaugaagaagcucugaggcaaauucucagagaaucaggcggaauugacaaggaagcaaugggauucacauacaguggaauaagaacuaauggagcaaccagugcauguaggagaucaggaucuucauucuaugcagaaaugaaauggcuccugucaaacacagaugaugcugcauucccgcagaugacuaagucauauaaaaauacaagaaaaagcccagcucuaauaguaugggggauccaucauuccguaucaacugcagagcaaaccaagcuauaugggaguggaaacaaacuggugacaguugggaguucuaauuaucaacaaucuuuuguaccgaguccaggagcgagaccacaaguuaauggucuaucuggaagaauugacuuucauuggcuaaugcuaaaucccaaugauacagucacuuucaguuucaauggggcuuucauagcuccagaccgugcaagcuuccugagaggaaaaucuaugggaauccagaguggaguacagguugaugccaauugugaaggggacugcuaucauaguggagggacaauaauaaguaacuugccauuucagaacauagauagcagggcaguuggaaaauguccgagauauguuaagcaaaggagucugcugcuagcaacagggaugaagaauguuccugagauuccaaagggaagaggccuauuuggugcuauagcggguuucauugaaaauggaugggaaggccuaauugaugguugguaugguuucagacaccagaaugcacagggagagggaacugcugcagauuacaaaagcacucaaucggcaauugaucaaauaacaggaaaauuaaaccggcuuauagaaaaaaccaaccaacaauuugaguugauagacaaugaauucaaugagguagagaagcaaaucgguaaugugauaaauuggaccagagauucuauaacagaaguguggucauacaaugcugaacucuugguagcaauggagaaccagcauacaauugaucuggcugauucagaaauggacaaacuguacgaacgagugaaaagacagcugagagagaaugcugaagaagauggcacugguugcuuugaaauauuucacaagugugaugaugacuguauggccaguauuagaaauaacaccuaugaucacagcaaauacagggaagaggcaaugcaaaauagaauacagauugacccagucaaacuaagcagcggcuacaaagaugugauacuuugguuuagcuucggggcaucauguuucauacuucuagccauuguaaugggccuugucuucauauguguaaagaauggaaacaugcggugcacuauuuguauauaa

SEQ ID NO: 42878 - RNA, 1701 nt, Artificial Sequence
  hemagglutinin__InfluenzaA__AIC64889
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagaaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42879 - RNA, 1701 nt, Artificial Sequence
  hemagglutinin__InfluenzaA__AIC73738
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuucguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccaucuauucaaucuagaggccuauucggggccauugccggcuuuauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42880 - RNA, 1701 nt, Artificial Sequence
  hemagglutinin__InfluenzaA__AIC73739
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuucguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagacaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42881 - RNA, 1701 nt, Artificial Sequence
  hemagglutinin__InfluenzaA__AIC73740
augaaggcaauacuaguaguucugcuauauacauuuacaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaccuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaaccggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuagacagagaaaaaauagaugggguaaggcuggaaucaacaaggauuuaccagauuuuggcgaucuauucaacugucgccaguucauugguacugguagucucccuaggggcaaucagcuucuggaugugcucuaaugggucucuacaguguagaauauguauuuaa

SEQ ID NO: 42882 - RNA, 1701 nt, Artificial Sequence
  hemagglutinin__InfluenzaA__AIC73741
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucauugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaagcuguuugaaaaaacaaagaagcaacugagggaaaaugcugaggauaugggcaauggcuguuucaaaauauaccacagaugugacaaugccugcauaggaucaaucagaaauggaacuuaugaccacaauguauacagggaugaagcauuaaacaaccgguuccagaucaggggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42883 - RNA, 1701 nt, Artificial Sequence
  hemagglutinin__InfluenzaA__AIC73742
augaaggcaauacuaguaguucugcuauauacauuugcaaccgcaaaugcagacacauuauguauagguuaucaugcgaacaauucaacagacacuguagacacaguacuagaaaagaacguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcuccgccaauccuacauuaaugauaaagggaaagaaguccucgugcuguggggcauucaccacccaucuacuacuacugaccaacaaagucucuaucagaaugcagaugcauauguuuuuguggggacaucaagauacagcaagaaguucaagccggaaauagcaauaagacccaaagugagggaucaagaaggaagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauagaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauuggugcugguagucucccugggggcaaucagcuucuggaugugcucuaaugggucucuacaguguagaauauguauuuaa

SEQ ID NO: 42884 - RNA, 1701 nt, Artificial Sequence; identical to SEQ ID NO: 42883
  hemagglutinin__InfluenzaA__AIC73743

SEQ ID NO: 42885 - RNA, 1701 nt, Artificial Sequence
  hemagglutinin__InfluenzaA__AIC73744
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucaaccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccagcccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42886 - RNA, 1701 nt, Artificial Sequence
  hemagglutinin__InfluenzaA__AIC73745
augaaggcaauacuaguaguucugcuauauacauuugcaaccgcaaaugcagacacuuuauguauagguuaucaugcgaacaauucaacagacacuguagacacaguacuagaaaagaauguaacaguaacacacucuguuaaccuucuagaagacaagcauaacgguaaacuaugcaaacuaagagggguagccccauugcauuuggguaaauguaacauugcuggcuggauccugggaaauccagagugugaaucacuauccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagucaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacugggcacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggcaacaggauugaggaauaucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaacucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42887 - RNA, 1701 nt, Artificial Sequence
  hemagglutinin__InfluenzaA__AIC73746
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguaaccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacuacugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucacuacaguguagaauauguauuuaa

SEQ ID NO: 42888 - RNA, 1701 nt, Artificial Sequence
  hemagglutinin__InfluenzaA__AIC73747
augaaggcaauacuaguaguucugcuauauacacuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacggcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucacgacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucacaauggaaagaaauacuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccuuaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaaacuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42889 - RNA, 1701 nt, Artificial Sequence
  hemagglutinin__InfluenzaA__AIC73748
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuucguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccuuccauuucagaauauacauccgaucacaauuggaaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaaaguugaugaugguuucuuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42890 - RNA, 1701 nt, Artificial Sequence
  hemagglutinin__InfluenzaA__AIC73749
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggaaaaaacugcacacuaauagaugcucuauugggagacccucagugugauggcuuucaaaauaaaagaugggaccuuuuuguugaacgaagcaaagccuacagcaacuguuacccuuaugaugugccggauuaugccucccuuaggucacuaguugccucauccggcacacuggaguuuaacgaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacagacaaggaccaaaucuuccuguaugcucacucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggcaaaugcaagucugaaugcaucacuccaaauggaagcauuaccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42891 - RNA, 1701 nt, Artificial Sequence
  hemagglutinin__InfluenzaA__AIC73750
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucaaaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42892 - RNA, 1701 nt, Artificial Sequence
  hemagglutinin__InfluenzaA__AIC73754
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuucguggggacaucaagauacagcaggaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42893 - RNA, 1701 nt, Artificial Sequence
  hemagglutinin__InfluenzaA__AIC73755
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42894 - RNA, 1701 nt, Artificial Sequence; identical to SEQ ID NO: 42893
  hemagglutinin__InfluenzaA__AIC73756

SEQ ID NO: 42895 - RNA, 1701 nt, Artificial Sequence; identical to SEQ ID NO: 42893
  hemagglutinin__InfluenzaA__AIC73757

SEQ ID NO: 42896 - RNA, 1701 nt, Artificial Sequence
  hemagglutinin__InfluenzaA__AIC73758
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggauagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaucaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42897 - RNA, 1701 nt, Artificial Sequence
  hemagglutinin__InfluenzaA__AIC73760
augaaggcaauacuaauaguucugcuauauacauuugcaaccgcaaaugcagacacauuauguauagguuaucaugcgaacaauucaacagauacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacggcaaguucaugguccuacauuguggaaacaucuaguucagacaauggaacauguuacccaggagauuucaucaauuaugaggagcuaagagagcaauugagcucagugucaucauuugaaagguuugagauauuccccaagacgaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgaaggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacaggaaugguagauggaugguacgguuaucaccaucaaaaugagcagggaucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggaugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42898 - RNA, 1701 nt, Artificial Sequence; identical to SEQ ID NO: 42897
  hemagglutinin__InfluenzaA__AIC73761

SEQ ID NO: 42899 - RNA, 1701 nt, Artificial Sequence
  hemagglutinin__InfluenzaA__AIC73762
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagaaccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccagaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42900 - RNA, 1701 nt, Artificial Sequence
  hemagglutinin__InfluenzaA__AIC73763
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagaucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguagguaaagaguucaaccacuuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaggcaaaauuaaacagagaaaaaauagaugggguaaaacuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42901 - RNA, 1701 nt, Artificial Sequence; identical to SEQ ID NO: 41526
  hemagglutinin__InfluenzaA__AIC73765

SEQ ID NO: 42902 - RNA, 1701 nt, Artificial Sequence
  hemagglutinin__InfluenzaA__AIC73766
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggagcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaaacuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42903 - RNA, 1701 nt, Artificial Sequence
  hemagglutinin__InfluenzaA__AIC73767
augaaggcaauacuaguaguucugcuauauacauuugcaaccgcaaaugcagacacuuuauguauagguuaucaugcgaacaauucaacagacacuguagacacaguacuagaaaagaauguaacaguaacacacucuguuaaccuucuagaagacaaacauaacgguaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaauuaaaaaaggaaauucauacccaaagcucagucaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggcaacaggauugaggaauaucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaacucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagauaagaaaccaguuaaaaaacaaugccaaggaaauuggaaacggcugcuuugaauuuuaccacaaaugcgauaacaugugcauggaaagugucaaaaaugggacuuaugacuacccaaaauacucagaggaagcaaaauuaaacagagaaaaaauagaugggguaaagcuggaaucaacaaggauuuaccagauuuuggcgaucuacucaacugucgccaguucauugguacugguagucucccugggggcaaucagcuucuggaugugcucuaaugggucucuacaauguagaauauguauuuaa

SEQ ID NO: 42904 - RNA, 1701 nt, Artificial Sequence
  hemagglutinin__InfluenzaA__AIC73768
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagggagcaauugagcucagugucaucauuugaaagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauugggaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccaucgacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42905 - RNA, 1701 nt, Artificial Sequence
  hemagglutinin__InfluenzaA__AIC73769
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagggagcaauugagcucagugucaucauuugaaagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaaggaaugcuggaucugguauuaucauuucagauacaccaguccacgauugcaauacaacuugucagacacccgagggugcuauaaacaccagccucccauuucagaauauacauccgaucacaauugggaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42906 - RNA, 1701 nt, Artificial Sequence
  hemagglutinin__InfluenzaA__AIC73770
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagggagcaauugagcucagugucaucauuugagagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauugggaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42907 - RNA, 1701 nt, Artificial Sequence
  hemagglutinin__InfluenzaA__AIC73771
augaaggcaauacuaguaguucugcuauauacauuugcaaccgcaaaugcagacacauuauguauagguuaucaugcgaacaauucaacagauacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacauguuacccaggagauuucaucaauuaugaggagcuaagagagcaauugagcucagugucaucauuugaaagguuugagauauuccccaagacgaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgaaggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccgguuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugcugaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42908 - RNA, 1701 nt, Artificial Sequence
  hemagglutinin__InfluenzaA__AIC73772
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccuuccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaggcaaaauuaaacagagaaaaaauagaugggguaaaacuggaaucaacaaggguuuaccagauuuuggcgaucuauucaacugucgccaguucauugguacugguagucucccugggggcaaucagcuucuggaugugcucuaaugggucucuacaguguagaauauguauuuaa

SEQ ID NO: 42909 - RNA, 1701 nt, Artificial Sequence; identical to SEQ ID NO: 42907
  hemagglutinin__InfluenzaA__AIC73773

SEQ ID NO: 42910 - RNA, 1701 nt, Artificial Sequence
  hemagglutinin__InfluenzaA__AIC73775
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagggagcaauugagcucagugucaucauuugaaagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccaagauaugcauucacaauggaaagaaaugcuggaucugguauuaucauuucagauacaccaguccacgauugcaauacaacuugucagacacccgagggugcuauaaacaccagccucccauuucagaauauacauccgaucacaauugggaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccaucgacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42911 - RNA, 1701 nt, Artificial Sequence
  hemagglutinin__InfluenzaA__AIC73776
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguucucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaguggugccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42912 - RNA, 1701 nt, Artificial Sequence; identical to SEQ ID NO: 42908
  hemagglutinin__InfluenzaA__AIC73777

SEQ ID NO: 42913 - RNA, 1701 nt, Artificial Sequence
  hemagglutinin__InfluenzaA__AIC73778
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagcccacagcaacuguuacccuuaugaugugccggauuaugccucccuuaggucacuaguugccucauccggcacacuagaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacagaaucacauacggggccugucccagauauguuaagcaaagcacucugaaacuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42914 - RNA, 1701 nt, Artificial Sequence; identical to SEQ ID NO: 42913
  hemagglutinin__InfluenzaA__AIC73779

SEQ ID NO: 42915 - RNA, 1701 nt, Artificial Sequence; identical to SEQ ID NO: 42913
  hemagglutinin__InfluenzaA__AIC73780

SEQ ID NO: 42916 - RNA, 1701 nt, Artificial Sequence
  hemagglutinin__InfluenzaA__AIC73781
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaauucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauauccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauauucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42917 - RNA, 1701 nt, Artificial Sequence
  hemagglutinin__InfluenzaA__AIC73782
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagcccacagcaacuguuacccuuaugaugugccggauuaugccucccuuaggucacuaguugccucauccggcacacuagaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacagaaucacauacggggccugucccagauauguuaagcaaagcacucugaaacuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42918 - RNA, 1701 nt, Artificial Sequence; identical to SEQ ID NO: 42913
  hemagglutinin__InfluenzaA__AIC73783

SEQ ID NO: 42919 - RNA, 1701 nt, Artificial Sequence; identical to SEQ ID NO: 42913
  hemagglutinin__InfluenzaA__AIC73784

SEQ ID NO: 42920 - RNA, 1701 nt, Artificial Sequence
  hemagglutinin__InfluenzaA__AIC73785
augaaggcaauacuaguaguucugcuauauacauuugcaaccgcaaaugcagacacauuauguauagguuaucaugcgaacaauucaacagauacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacauguuacccaggagauuucaucaauuaugaggagcuaagagagcaauugagcucagugucaucauuugaaagguuugagauauuccccaagacgaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgaaggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacggcuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguuuuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42921 - RNA, 1701 nt, Artificial Sequence; identical to SEQ ID NO: 42913
  hemagglutinin__InfluenzaA__AIC73786

SEQ ID NO: 42922 - RNA, 1701 nt, Artificial Sequence
  hemagglutinin__InfluenzaA__AIC73787
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagggagcaauugagcucagugucaucauuugagagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucguacuguggggcauucaccauccaucuacuacugcugaccaacaaagucucuaucagaaugcagaugcauauguuuuuguggggacaucaagauacagcaagaaguucaagccggaaauagcaauaagacccaaagugagagaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauugggaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42923 - RNA, 1701 nt, Artificial Sequence; identical to SEQ ID NO: 42910
  hemagglutinin__InfluenzaA__AIC73788

SEQ ID NO: 42924 - RNA, 1701 nt, Artificial Sequence
  hemagglutinin__InfluenzaA__AIC73789
augaagacuaucauugcuuugagcuacauucuaugucugguuuucgcucaaaaaccuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagucaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggcuugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaccaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuucagaucaagggaguugagcugaagucaggguacaaagauuggauccuauggauuuccuuugccauaucauguuuuuugcuuuguguuguuuuguugggguucaucaugugggccugccaaaagggcaacauuaggugcaacauuugcauuuga

SEQ ID NO: 42925 - RNA, 1701 nt, Artificial Sequence
  hemagglutinin__InfluenzaA__AIC73790
augaaggcaauacuaguaguucugcuauauacauuugcaaccacaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcaugcccucacgcuggagcaaaaagcuucuacaaaaauuuaauauggcuaguuaaaaaaggaaauucauacccaaagcuccgccaauccuacauuaaugauaaagggaaagaaguccucgugcuguggggcauucaccacccaucuacuacuacugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42926 - RNA, 1701 nt, Artificial Sequence
  hemagglutinin__InfluenzaA__AIC73791
augaaggcaauacuaguaguucugcuauauacauuugcaaccgcaaaugcagacacauuauguauagguuaucaugcgaacaauucaacagauacuauagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacauguuacccaggagauuucaucaauuaugaggagcuaagagagcaauugagcucagugucaucauuugaaagguuugagauauuccccaagacgaguucauggcccaaucaugacucgaacaaagguguaacggcagcaugcccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgaaggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggaugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuacucaacugucgccaguucauugguacugguagucucccugggggcaaucagcuucuggaugugcucuaaugggucucuacaguguagaauauguauuuaa

SEQ ID NO: 42927 - RNA, 1701 nt, Artificial Sequence; identical to SEQ ID NO: 42920
  hemagglutinin__InfluenzaA__AIC73792

SEQ ID NO: 42928 - RNA, 1701 nt, Artificial Sequence
  hemagglutinin__InfluenzaA__AIC73793
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccuuccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggauuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaggcaaaauuaaacagagaaaaaauagaugggguaaaacuggaaucaacaaggguuuaccagauuuuggcgaucuauucaacugucgccaguucauugguacugguagucucccugggggcaaucagcuucuggaugugcucuaaugggucucuacaguguagaauauguauuuaa

SEQ ID NO: 42929 - RNA, 1701 nt, Artificial Sequence
  hemagglutinin__InfluenzaA__AIC73794
augaagacuaucauuggagugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucuucuugcauaaggggaucuaauaguaguuucuuuaguagauuaaauugguugacccacuuaaacuccaaauacccagcauuaaacgugacuaugccaaacaaugaacaauuugacaaauuguacauuugggggguucaccacccggguacggacaaggaccaaaucuuccuguaugcacaaucaucaggaagaaucacaguaucuaccaaaagaagccaacaagcuguaaucccgaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagagacaaacuagaggcauauuuggcgcaauagcggguuucauagaaaaugguugggagggaaugguggaugguugguacggcuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42930 - RNA, 1701 nt, Artificial Sequence
  hemagglutinin__InfluenzaA__AIC73796
augaaggcaauacuaguaguucugcuauauacauuugcaaccgcaaaugcagacacauuauguauagguuaucaugcgaacaauucaacagauacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacauguuacccaggagauuucaucaauuaugaggagcuaagagagcaauugagcucagugucaucauuugaaagguuugagauauuccccaagacgaguucauggcccaaucaugacucgaacaaagguguaacggcagcaugcccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgaaggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggaugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuacucaacugucgccaguucauugguacugguagucucccugggggcaaucagcuucuggaugugcucuaaugggucucuacaguguagaauauguauuuaa

SEQ ID NO: 42931 - RNA, 1701 nt, Artificial Sequence
  hemagglutinin__InfluenzaA__AIC73797
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucuucuugcauaaggggaucuaauaguaguuucuuuaguagauuaaauugguugacccacuuaaacuccaaauacccagcauuaaacgugacuaugccaaacaaugaacaauuugacaaauuguacauuugggggguucaccacccggguacggacaaggaccaaaucuuccuguaugcacaaucaucaggaagaaucacaguaucuaccaaaagaagccaacaagcuguaaucccgaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagagacaaacuagaggcauauuuggcgcaauagcggguuucauagaaaaugguugggagggaaugguggaugguugguacggcuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42932 - RNA, 1701 nt, Artificial Sequence
  hemagglutinin__InfluenzaA__AIC73798
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucuucuugcauaaggggaucuaauaguaguuucuuuaguagauuaaauugguugacccacuuaaacuccaaauacccagcauuaaacgugacuaugccaaacaaugaacaauuugacaaauuguacauuugggggguucaccacccggguacagacaaggaccaaaucuuccuguaugcacaaucaucaggaagaaucacaguaucuaccaaaagaagccaacaagcuguaaucccgaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagagacaaacuagaggcauauuuggcgcaauagcggguuucauagaaaaugguugggagggaaugguggaugguugguacggcuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42933 - RNA, 1701 nt, Artificial Sequence
  hemagglutinin__InfluenzaA__AIC73800
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucuucuugcauaaggggaucuaauaguaguuucuuuaguagauuaaauugguugacccacuuaaacuccaaauacccagcauuaaacgugacuaugccaaacaaugaacaauuugacaaauuguacauuugggggguucaccacccggguacggacaaggaccaaaucuuccuguaugcacaaucaucaggaagaaucacaguaucuaccaaaagaagccaacaagcuguaaucccgaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggcaugucccagauauguuaagcaaagcacucugaaauuggcaacaggaaugcgaaauguaccagagagacaaacuagaggcauauuuggcgcaauagcggguuucauagaaaaugguugggagggaaugguggaugguugguacggcuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42934 - RNA, 1701 nt, Artificial Sequence; identical to SEQ ID NO: 42931
  hemagglutinin__InfluenzaA__AIC73801

SEQ ID NO: 42935 - RNA, 1701 nt, Artificial Sequence; identical to SEQ ID NO: 42932
  hemagglutinin__InfluenzaA__AIC73802

SEQ ID NO: 42936 - RNA, 1701 nt, Artificial Sequence; identical to SEQ ID NO: 42932
  hemagglutinin__InfluenzaA__AIC73803

SEQ ID NO: 42937 - RNA, 1701 nt, Artificial Sequence; identical to SEQ ID NO: 42931
  hemagglutinin__InfluenzaA__AIC73804

SEQ ID NO: 42938 - RNA, 1701 nt, Artificial Sequence; identical to SEQ ID NO: 42932
  hemagglutinin__InfluenzaA__AIC73805

SEQ ID NO: 42939 - RNA, 1701 nt, Artificial Sequence; identical to SEQ ID NO: 42932
  hemagglutinin__InfluenzaA__AIC73806

SEQ ID NO: 42940 - RNA, 1701 nt, Artificial Sequence
  hemagglutinin__InfluenzaA__AIC73807
augaaggcaauacuaguaguucugcuauauacauuugcaaccgcaaaugcagacacauuauguauagguuaucaugcgaacaauucaacagauacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacauguuacccaggagauuucaucaauuaugaggagcuaagagagcaauugagcucagugucaucauuugaaagguuugagauauuccccaagacgaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaauaauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgaaggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42941 - RNA, 1701 nt, Artificial Sequence; identical to SEQ ID NO: 42931
  hemagglutinin__InfluenzaA__AIC73808

SEQ ID NO: 42942 - RNA, 1701 nt, Artificial Sequence
  hemagglutinin__InfluenzaA__AIC73809
augaaggcaauacuaguaguucugcuauauacauuugcaaccgcaaaugcagacacauuauguauagguuaucaugcgaacaauucaacagacacuguggacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcuccgccaauccuacauuaaugauaaagggaaagaaguccucgugcuguggggcauucaccacccaucuacuacuacugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugagguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42943 - RNA, 1701 nt, Artificial Sequence
  hemagglutinin__InfluenzaA__AIC73810
augaaagcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucaaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccaggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacagaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42944 - RNA, 1701 nt, Artificial Sequence
  hemagglutinin__InfluenzaA__AIC73813
augaaggcaauacuaguaguucugcuauauacauuugcaaccgcaaaugcagacacauuauguauagguuaucaugcaaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaaaacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaacucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggaugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugccgccaguucauugguacugguaaucucccugggggcaaucagcuucuggaugugcucuaaugggucucuacaguguagaauauguauuuaa

SEQ ID NO: 42945 - RNA, 1701 nt, Artificial Sequence
  hemagglutinin__InfluenzaA__AIC73815
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42946 - RNA, 1701 nt, Artificial Sequence; identical to SEQ ID NO: 42452
  hemagglutinin__InfluenzaA__AIC73817

SEQ ID NO: 42947 - RNA, 1701 nt, Artificial Sequence
  hemagglutinin__InfluenzaA__AIC73819
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuucguggggacaucaagauacagcaagaaguucaagccggaaauagcaauaagacccaaaguaagggaucaagaagggagaaugaacuauuacuggacacuaguagagccgggagacaaaauaacauuugaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42948 - RNA, 1701 nt, Artificial Sequence
  hemagglutinin__InfluenzaA__AIC73820
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauauugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42949 - RNA, 1701 nt, Artificial Sequence; identical to SEQ ID NO: 42405
  hemagglutinin__InfluenzaA__AIC73821

SEQ ID NO: 42950 - RNA, 1701 nt, Artificial Sequence
  hemagglutinin__InfluenzaA__AIC73824
augaaggcaauacuaguaguucugcuauauacauuugcaaccgcaaaugcagauacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucacaauggaaagaaaugcugggucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaggcaaaauuaaacagagaaaaaauagaugggguaaaacuggaaucaacaaggguuuaccagauuuuggcgaucuauucaacugucgccaguucauugguacugguagucucccugggggcaaucagcuucuggaugugcucuaaugggucucuacaguguagaauauguauuuaa

SEQ ID NO: 42951 - RNA, 1701 nt, Artificial Sequence; identical to SEQ ID NO: 42405
  hemagglutinin__InfluenzaA__AIC73825

SEQ ID NO: 42952 - RNA, 1701 nt, Artificial Sequence
  hemagglutinin__InfluenzaA__AIC73827
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaccacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaaacucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaggggucaggauaugcagcagaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaaacuggaaucaacaaggauuuaccagauuuuggcgaucuauucaacugucgccaguucauugauacugguagucucccugggggcaaucagcuucuggaugugcucuaaugggucucuacaguguagaauauguauuuaa

SEQ ID NO: 42953 - RNA, 1701 nt, Artificial Sequence
  hemagglutinin__InfluenzaA__AIC73828
augaaggcaauacuaguaguucugcuauauacauuugcaacugcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaccaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugccgccaguucauugguacugguagucucccugggggcaaucagcuucuggaugugcucuaaugggucucuacaguguagaauauguauuuaa

SEQ ID NO: 42954 - RNA, 1701 nt, Artificial Sequence
  hemagglutinin__InfluenzaA__AIC73830
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaaaagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaauucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacaggaaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42955 - RNA, 1701 nt, Artificial Sequence
  hemagglutinin__InfluenzaA__AIC73833
augaaggcaauacuaguaguucugcuauauacauuugcaaccgcaaaugcagacacauuauguauagguuaucaugcaaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaaaacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaacucugucauugaaaagaugaauacacaguucacagcaguggguaaagaguucaaccaccuggaaaaaagaauagagaauuugaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugccgccaguucauugguacugguagucucccugggggcaaucagcuucuggaugugcucuaaugggucucuacaguguagaauauguauuuaa

SEQ ID NO: 42956 - RNA, 1701 nt, Artificial Sequence
  hemagglutinin__InfluenzaA__AIC73834
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucgaacaaagguguaacggcagcauguccucacgauggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcuggccaacaaagucucuaucagaaugcagaugcauauguuuucguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggguugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42957 - RNA, 1701 nt, Artificial Sequence
  hemagglutinin__InfluenzaA__AIC73835
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucaguaucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaauagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguuuuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuuauggaugugcucuaaugggucucuacaguguagaauauguauuuaa

SEQ ID NO: 42958 - RNA, 1701 nt, Artificial Sequence
  hemagglutinin__InfluenzaA__AIC73836
augaaggcaauacuaguaguucugcuauauacauuugcaaccgcaaaugcagacacguuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagaucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaggcaaaauuaaacagagaaaaaauagaugggguaaaacuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42959 - RNA, 1701 nt, Artificial Sequence
  hemagglutinin__InfluenzaA__AIC73837
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaggccuacagcaacuguuacccuuaugaugugccggauuaugccucccuuaggucacuaguugccucauccggcacacuggaguuuaacaaugaaagcuucaauugggcuggagucacucaaaacggaacaagcucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42960 - RNA, 1701 nt, Artificial Sequence
  hemagglutinin__InfluenzaA__AIC73838
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcaacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucagucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaauuaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagagaaaaugcugaggaucugggcaaugguuguuucaaaauauaccacaaaugugacaaugccugcauaggaucaaucagaaauggaacuuaugaccacgauguauacagggaugaggcauuaaacaaccgguuccaaaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 42961 - RNA, 1701 nt, Artificial Sequence
  hemagglutinin__InfluenzaA__AIC73839
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccgaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaucaccuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaacuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42962 - RNA, 1701 nt, Artificial Sequence
  hemagglutinin__InfluenzaA__AIC73840
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccaugauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaacgagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42963 - RNA, 1701 nt, Artificial Sequence
  hemagglutinin__InfluenzaA__AIC73841
augaaggcaauacuaguaguucugcuauauacauuugcaaccgcaaaugcagacacuuuauguauagguuaucaugcgaacaauucaacagacacuguagacacaguacuagaaaagaauguaacaguaacacacucuguuaaccuucuagaagacaagcauaacgguaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagucaauccuacauuaaugauaaagggaaagaaguccucgugcuguggggcauucaccauccaucuacuauugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggcaacaggauugaggaauauaccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaacucuguuauugaaaagaugaauacacaguucacagcaguggguaaagaguucaaccaccuggaaaaaagaauugagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 42964 - RNA, 1701 nt, Artificial Sequence; identical to SEQ ID NO: 42959
  hemagglutinin__InfluenzaA__AIC73842

SEQ ID NO: 42965 - RNA, 1707 nt, Artificial Sequence
  hemagglutinin__InfluenzaA__AID48082
auggagaaaauagugcuucuuuuugcaauagucagucuuguuaaaagugaucagauuugcauugguuaccaugcaaacaacucgacagagcagguugacacaauaauggaaaagaacguuacuguuacacaugcccaagacauacuggaaaagacacacaacgggaagcucugcgaucuagauggagugaagccucuaauuuugagagauuguaguguagcuggauggcuccucggaaacccaaugugugacgaauucaucaaugugccggaauggucuuacauaguggagaaggccaauccagucaaugaccucuguuacccaggggauuucaaugacuaugaagaauugaaacaccuauugagcagaauaaaccauuuugagaaaauucagaucauccccaaaaguucuugguccagucaugaagccucauuaggggugagcucagcauguccauaccagggaaaguccuccuuuuucagaaaugugguauggcuuaucaaaaagaacaguacauacccaacaauaaagaggagcuacaauaauaccaaccaagaagaucuuuugguacugugggggauucaccauccuaaugaugcggcagagcagacaaagcucuaucaaaacccaaccaccuauauuuccguugggacaucaacacuaaaccagagauugguaccaagaauagcuacuagauccaaaguaaacgggcaaaguggaaggauggaguucuucuggacaauuuuaaaaccgaaugaugcaaucaacuucgagaguaauggaaauuucauugcuccagaauaugcauacaaaauugucaagaaaggggacucaacaauuaugaaaagugaauuggaauaugguaacugcaacaccaagugucaaacuccaaugggggcgauaaacucuaguaugccauuccacaauauacauccucucaccaucggggaaugccccaaauaugugaaaucaaacagauuaguccuugcgacugggcucagaaauagcccucaaagagagagaagaagaaaaaagagaggauuauuuggagcuauagcagguuuuauagagggaggauggcagggaaugguagaugguugguauggguaccaccauagcaaugagcaggggaguggguacgcugcagacaaagaauccacucaaaaggcaauagauggagucaccaauaaggucaacucgaucauugacaaaaugaacacucaguuugaggccguuggaagggaauuuaaccacuuagaaaggagaauagagaauuuaaacaagaagauggaagacggguuccuagaugucuggacuuauaaugcugaacuucugguucucauggaaaaugagagaacucuagacuuucaugacucaaaugucaagaaccuuuacgacaagguccgacuacagcuuagggauaaugcaaaggagcuggguaacgguuguuucgaguucuaucauaaaugugaugaugaauguauggaaaguguaagaaacggaacguaugacuacccgcaguauucagaagaagcaagacuaaaaagagaggaaauaaguggaguaaaauuggaaucgauaggaauuuaccaaauacugucaauuuauucuacaguggcgaguucccuagcacuggcaaucaugguagcuggucuauccuuauggaugugcuccaaugggucguuacaaugcagaauuugcauuuaa

SEQ ID NO: 42966 - RNA, 1701 nt, Artificial Sequence
  hemagglutinin__InfluenzaA__AID70444
augaaggcaguacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucgccacagcaagcucaugguccuacauaguggaaacaucuaauucagacaauggaacguguuacccaggagauuucaucgauuaugaggagcuaagagagcaguugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggagagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugcagaacuguugguuguauuggaaaaugaaagaacuuuggaauaccaugauucaaaugugaagaacuuauaugaaaagguaagaagccaggugaaaaacaaugccaaggaaauuggaaacggcuguuuugaauuuuaccacaaaugcgauaacacgugcauggaaagugucaaaaaugggacuuaugacuacccaaaauacucagaggaagcaaaauuaaacagagaagaaauagauggggugaagcuggaaucaacaaggauuuaccagauuuuggcgaucuauucaacugucgccaguucauugguacugguagucucccugggggcaaucaguuucuggaugugcuuuaaugggucucuacaguguagaauauauauauaa

SEQ ID NO: 42967 - RNA, 1701 nt, Artificial Sequence
  hemagglutinin__InfluenzaA__AID70445
augaaggcaauacuaguaguucugcuauauacauuugcaaccgcaaaugcagacacauuauguauagguuaucaugcgaacaauucaacagacacuguagacacaguacuugaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaguaguaccgagauaugcauucgcaauggaaagaaaugcuggaucugguauuaucauuucagauacaccaguccacgauugcaauacaacuugucagacacccaagggugcuauaaacaccagccuuccauuucagaauauacauccgaucacaauuggaaaauguccaaaauauguaaaaagcacaaaauugagacuggccacaggauugaggaaugucccuucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguuguauuggaaaaugaaagaacuuuggaauaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggauuuaugacuacccaaaauacucagaggaagcaaaauuaaacagagaagaaauagaugggguaaagcuggaaucaacaaggauuuaccagauuuuggcgaucuauucaacugucgccaguucauugguacagguagucucccugggggcaaucaguuuuuggaugugcuuuaaugggucucuacaguguagaauauguauuuaa

SEQ ID NO: 42968 - RNA, 1701 nt, Artificial Sequence
  hemagglutinin__InfluenzaA__AID70446
augaaggcaguacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaauccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuggugguaccgagauaugcauucgcaauggaaagaaaugcuggaucugguauuaucauuucagguacaccaguccacgauugcaauacaacuugucagacacccaagggugcuauaaacaccagccucccguuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaauuguugguuguauuggaaaaugaaagaacuuuggaauaccacgauucaaaugugaagaacuuauaugaaaagguaagaaaccaguuaaaaaacaaugccaaggaaauuggaaauggcugcuuugaauuuuaccacaaaugugauaacacgugcauggaaagugucaaaaaugggauuuaugacuacccaaaauacucagaggaagcaaaauuaaacagagaagaaauagaugggguaaagcuggaaucaacaaggauuuaccagauuuuggcgaucuauucaacugucgccaguucauugguacagguagucucccugggggcaaucaguuuuuggaugugcuuuaaugggucucuacaguguagaauauguauuuaa

SEQ ID NO: 42969 - RNA, 1701 nt, Artificial Sequence
  hemagglutinin__InfluenzaA__AID70447
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaagcuggagcaaaaggcuucuacaaaaauuuacuauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaguugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacuucaguagguaaagaguucaaccaccuggaaaaaagaauggagaauuuaaauaaaaaaguugaugaugguuuccuggacauuuggacuuacaaugccgaacuguugguuguauuggaaaaugaaagaacuuuggaauaccacgauucaaaugugaagaacuuauaugaaaagguaagaaaccaguuaaaaaacaaugccaaggaaauuggaaauggaugcuuugaauuuuaccacaaaugcgauaacacgugcauggaaagugucaaaaaugggauuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcuuuaaugggucucuacaguguagaauauguauuuaa

SEQ ID NO: 42970 - RNA, 1701 nt, Artificial Sequence
  hemagglutinin__InfluenzaA__AID70448
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaucuucuagaagacaagcauaacgggaaacuaugcaaacuaagagggguagccccauugcaucuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagagaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucugucauugaaaagaugaauacacaguucacagcaguagguaaagaguucaaccaccuggaaaaaagaauagagaauuuaaauaaaaaaguugaugaugguuuccuggacauuuggacuuacaaugccgaauuguugguuguauuggaaaaugaaagaacuuuggaauaccaggauucaaaugugaagaacuuauaugaaaagguaagaaaccaguuaaaaaacaaugccaaggaaauuggaaauggcugcuuagaauuuuaccacaaauuugauaacacguguauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccuggggacaaucaguuuuuggaugugcuuuaaugggucucuacaguguagaauauguauuuaa

SEQ ID NO: 42971 - RNA, 1701 nt, Artificial Sequence
  hemagglutinin__InfluenzaA__AID70449
augaaggcaauacuaguaguucugcuauauacauuugcaaccgcaaaugcugacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggaucuugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacugcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaaugucccaaauauguaaaaagcacaaaauugagacuggccacaggauugaggaaugucccgucuauucaaucuagaggccuauuuggggccauugccggcuucauugaagggggcuggacagggaugguagauggaugguaugguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguuguauuggaaaaugaaagaacuuuggaauaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauuaguacugguaguuucccugggggcaaucaguuuuuggaugugcuuuaaugggucucuacaguguagaauauguguuuaa

SEQ ID NO: 42972 - RNA, 1701 nt, Artificial Sequence
  hemagglutinin__InfluenzaA__AID70450
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaucuucuagaagacaagcauaacgggaaacuaugcaaacuaagagggguagccccauugcaucuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaaggaguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacauccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguuguauuggaaaaugaaagaacuuuggaauaccacgauucaaaugugaagaacuuauaugagaagguaagaaaccaguuaaaaaacaaugccaaggaaauuggaaauggcugcuuugaauuuuaccacaaauuugauaacacguguauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacagguagucucccugggggcaaucaguuuuuggaugugcuuuaaugggucucuacaguguagaauauguauuuaa

SEQ ID NO: 42973 - RNA, 1701 nt, Artificial Sequence
  hemagglutinin__InfluenzaA__AID70451
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguuguauuggaaaaugaaagaacuuuggaauaccacgauucaaaugugaagaacuuauaugaaaagguaagaaaccaguuaaaaaacaaugccaaggaaauuggaaauggcugcuuugaauuuuaccacaaguuugauaacacgugcauggaaagugucaaaaaugggacuuaugacuacccaaaauacucagaggaagcaaaauuaaacagagaagaaauagauggaguaaagcuggaaucaacaaggauuuaccagauuuuggcgaucuauucaacugucgccaguucauugguacugguagucucccugggggcaaucaguuuuuggaugugcuuuaaugggucucuacaguguagaauauguauuuaa

SEQ ID NO: 42974 - RNA, 1701 nt, Artificial Sequence
  hemagglutinin__InfluenzaA__AID70452
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaucuucuagaagacaagcauaacgggaaacuaugcaaacuaagagggguagccccauugcaucuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugggcucagugucaucauuuaaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggagcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguuguauuggaaaaugaaaggacuuuggaauaccacgauucaaaugugaagaacuuauaugagaagguaagaaaccaguuaaaaaacaaugccaaggaaauuggaaauggaugcuuugaauuuuaccacaaaugcgauaacacguguauggaaagugucaaaaaugggauuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuuuuggaugcgcuuuaaugggucucuacaguguaguauauguauuuaa

SEQ ID NO: 42975 - RNA, 1701 nt, Artificial Sequence
  hemagglutinin__InfluenzaA__AID70453
augaaggcaauacuaguaguucugcuauauacauuugcaaccgcaaaugcagacacauuauguauagguuaccaugcgaacaauucaacagacacuguagacacagugcuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucgcucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccaagauugcaauacaacuugucagacacccaagggugcuauaaacaccagccucccauuucagaauauacauccgaucacaauuggaaaauguccaaaauauguaaaaagcacaaaauugagacuggucacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguuguauuggaaaaugaaagaacuuuggaauaccacgauucaaaucugaagaacuuauaugaaaagguaagaaaccaguuaaaaaacaaugccaaggaaauuggaaauggcugcuuugaauuuuaccacaaauuugauaacacguguauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacagguagucucccugggugcaaucaguuuuuggaugcgcuuuaaugggucucuacauuguagaauauguauuuaa

SEQ ID NO: 42976 - RNA, 1701 nt, Artificial Sequence
  hemagglutinin__InfluenzaA__AID70454
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaaaugagacuggccacaggauugaggaaugucccguguauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguuguauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 42977 - RNA, 1701 nt, Artificial Sequence
  hemagglutinin__InfluenzaA__AID70455
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaucuucuagaagacaagcauaacgggaaacuaugcaaacuaggagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagaucagcaaauccuacauuaaugauaaagggaaagaaguccucgugcuauggggcauucaccauccaucuacuacugcugaccaacaaagucucuaucagaaugcagauacauauauuuuugugggaacaucaagauacagcaagaaguucaagccggaaauagcaauaagacccaaagugagggaucaagaagggagaaugaacuauuacuggacacuaguagagccgggagacaaaauaacauucgaggcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacaggaaugguagauggaugguacgguuaucaccaucaaaaugagcaggggucaggauaugcagccgaccugaagagcacacagaaugccauugacaagauuacuaacaaaguaaauucuguuauuaaaaagaugaauacacaguucacagcaguagguaaagaguucaaccaccuggaaaaaagaauagagaauuuaaauaaaaaaguugaugaugguuuccuggacauuuggacuuacaaugccgaacuguugguuguauuggaaaaugaaagaacuuuggaauaccacgauucaaaugugaagaacuuauaugaaaagguaagaaaccaguuaaaaaacaaugccaaggaaauuggaaauggaugcuuugaauuuuaccacaaauuugauaacacguguauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcuuuaaugggucucuacaguguagaauauguauuuaa

SEQ ID NO: 42978 - RNA, 1701 nt, Artificial Sequence
  hemagglutinin__InfluenzaA__AID70456
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggcuggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguaguuaaagaguucaaccaccuggaaaaaagaauagagaauuuaaauaaaaaaguugaugaugguuuccuggacauuuggacuuacaaugccgaacuguugguuguauuggaaaaugaaagaacuuuggaauaccacgauucaaaucugaagaacuuauaugaaaagguaagaaaccaguuaaaaaacaaugccaaggaaauuggaaauggcugcuuugaauuuuaccacaaauuugauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacagguagucucccugggggcaaucaguuuuuggaugugcuuuaaugggucucuacaguguagaauauguauuuaa

SEQ ID NO: 42979 - RNA, 1701 nt, Artificial Sequence
  hemagglutinin__InfluenzaA__AID70457
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaucuucuagaagacaagcauaacgggaaacuaugcaaacuaagagggguagccccauugcaucuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcgacuggaaaucuagugguaccgagauaugcauucgcaauggaaagagaugcuggaucugguauuaucauuucagauacaccaguccacgauugcaauacaacuugucagacacccaagggugcuauaaacaccagucucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguuguauuggaaaaugaaagaacuuuggaauaccacgauucaaaugugaagaacuuauaugagaagguaagaaaccaguuaaaaaacaaugccaaggaaauuggaaauggaugcuuugaauuuuaccacaaauuugauaacacguguauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacagguagucucccugggggcaaucaguuuuuggaagugcuuuaaugggucucuacaguguagaauauguaguuaa

SEQ ID NO: 42980 - RNA, 1701 nt, Artificial Sequence
  hemagglutinin__InfluenzaA__AID70458
augaagacuaucauugcuuugagcuacauucuaugucugguuuucgcucaaaaauuuccuggaaaugacaacagcauggcaacgcugugccuugggcaccaugcaguaccaaacggaacgauggugaaaacaauaacgaaugaccaaauugaaguuacuaaugcuacugagcugguucagaguuccucaacagguggaauaugcaacagcccucaucagauccuugauggaggaaacugcacacuaauagaugcucuauugggagacccucagugugauggcuuccagaauaagaaaugggaccuuuuuguugaacgcagcaaagccuacagcaacuguuacccuuaugaugugccggauuaugcaucccuuaggucaauaguugccucauccgguacacuggaauuuaacaaugaaagcuucaauuggacuggagucacucaaaauggaaaaagcgcuucuugcaaaaggggaucugacaacaguuucuuuaguagauugaauugguugacccacuuaaauuacaaauauccagcauugaaaguuacuaugccaaacaaugaaaaauuugacaaauuguacauuugggggguucaccacccggguacguacaaugaucaaaucagccuauaugcucaagcaucaggaauaaucacagucucuaccaaaagaaaccaacaaacugugaucccgaauaucggaucuagacccagaguaagggauauccccagcagaauaagcaucuauuggacaauagugaaaccgggagacauacuuuugauuaacagcacagggaaucuaauugcuccucgggguuacuucaaaauacaaagugggaaaagcucaauaaugagaucagaugcacccauuggcaaaugcaauucugaauguaucacuccaaauggaagcauucccaaugacaaaccauuucaaaauguaaauaggaucacauauggggccugucccagguauguuaagcaaaacacccuaaaauuggcaacaggaaugagaaauguuccagagaaacaaacuagaggcauauuuggcgcaaucgcggguuucauagaaaaugguugggagggaaugguugaugguugguacgguuucaggcaucaaaauucugagggaaugggacaagcagcagaucucaaaagcacucaagcagcgaucaaucaaaucaauggaaagcugaauagguugaucgggaaaaccauugagaaauuccaucagauugaaaaagaauucucagagguagaagggagaauucaggaccucgagaaauauguugaggacaccaaaauagaucucuggucauacaacgcggagcuucuuguugcccuggagaaccaacauacaauugaucuaacugacucagaaauggacaaacuguuugaaagaacaaagaagcaaaugagggaaaaugcugaagauaugggcaaugguuguuucaaaauauaccacaaaugugacaaugccugcauaggaucaaucagaaauggaauuuaugaccgugauauauacagggaugaagcauugagcaaccgguuccagaucaaagguguugagcugaaggcaggauacaaagauuggauccuauggauuuccuuugccauaucauguuuucugcucuguguuguuuuguugggguucaucaugugggccugccaaaagggcaaccuuaggugcaacauuugcauuuga

SEQ ID NO: 42981 - RNA, 1701 nt, Artificial Sequence
  hemagglutinin__InfluenzaA__AID70459
augaagacuaucauugcuuugagcuacauucuaugucugguuuucgcucaaaaaguuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuugaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaaaaagccaacaagcuguaauuccgaauaucggaucuagacccagaguaaggaauaucccuagcagaguaagcaucuauuggacaauaguaaaaccgggagauauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaccaggaaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaauugaucaaaucaaugggaagcugaauagauugaucgggaaaaccaucgagaaauuccaucagauugaaaaugaauucucagaagucgaagggagaauucaggaccuugagaaauauguugaggacacuaaaauagaucucuggucauacaucgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaauuuaugaccacgauguguacagagaugaagcauuaaacaaccgauuccagaucaagggaguugagcugaagucaggguacaaagauuggauccuauggauuuccuuugccauaucauguuuucugcucuguguugcuuuguugggguucaucaugugggccugccaaaaaggcaacauuaggugcaacauuugcauuuga

SEQ ID NO: 42982 - RNA, 1701 nt, Artificial Sequence
  hemagglutinin__InfluenzaA__AID70460
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuugaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaaaaagccaacaagcuguaauuccgaauaucggaucuagacccagaguaaggaauaucccuagcagaguaagcaucuauuggacaauaguaaaaccgggagauauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggauggaugguacgguuucaggcaucaaaauucugagggaaggggacaagcagcagaucucaaaagcacucaagcagcaauugaucaaaucaaugggaagcugaauagauugaucgggaaaaccaucgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucugaaaugaacaaacuguuugaaaaaacaaagaagcaacugagggaaaaugcugaggauaugggcaaugguuguuucaaaauauaccacaaaugugacaaugccugcauaggaucaaucagaaauggaauuuaugaccacgauguguacagagaugaagcauuaaacaaccgauuccagaucaagggaguugagcugaagucaggguacaaagauuggauccuauggauuuccuuugccauaucauguuuucugcucuguguugcuuuguugggguucaucaugugggccugccaaaaaggcaacauuaggugcaacauuugcauuuga

SEQ ID NO: 42983 - RNA, 1701 nt, Artificial Sequence
  hemagglutinin__InfluenzaA__AID70461
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuugaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaaaaagccaacaagcuguaauuccgaauaucggaucuagacccagaguaaggaauaucccuagcagaguaagcaucuauuggacaauaguaaaaccgggagauauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaauugaucaaaucaaugggaagcugaauagauugaucgggaaaaccaucgagaaauuccaucagauugaaaaagaauucucagaagucgaagggagaauucaggaccuugagaaauauauugaggacacuaaaauagaucuuuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaauuuaugaccacgauguguacagagaugaagcauuaaacaaccgauuccagaucaagggaguugagcugaagucaggguacaaagauuggauccuauggauuuccuuugccauaucauguuuucugcuuuguguugcuuuguugggguucaucaugugggccugccaaaaaggcaacauuaggugcaucacuugcauuuga

SEQ ID NO: 42984 - RNA, 1701 nt, Artificial Sequence
  hemagglutinin__InfluenzaA__AID70463
augaagacuaucauugcuuugagcuacauucuaugucugguuuucgcucaaaaaauuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuugaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaaaaagccaacaagcuguaauuccgaauaucggaucuagacccagaguaaggaauaucccuagcagaguaagcaucuauuggacaauaguaaaaccgggagauauacuuuugauuaacagcacagggaaucuaauugcuccuaggggcuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaucgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaauuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42985 - RNA, 1701 nt, Artificial Sequence
  hemagglutinin__InfluenzaA__AID70464
augaagacuaucauugcuuugagcuacauucuaugucugguuuucgcucaaaaacuuccuggagaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuugaacuucaaauacccagcauugaacgugacuaugccaaacaaugaacaauuugacaaauuguacauuugggggguucaccacccggguacggacaaggaccaaaucuuccuguaugcucaagcaucaggaaggaucacaguaucuaccaaaaaaagccaacaagcuguaauuccgaauaucggaucuagacccagaguaaggaauaucccuagcagaguaagcaucuauuggacaauaguaaaaccgggagauauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaucgagaaauuccaucagauugaaaaagaauucucagaagucgaagggagaauucaggaccuugagaaauauguugaggacacuaaaauagaucuuuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 42986 - RNA, 1701 nt, Artificial Sequence
  hemagglutinin__InfluenzaA__AID70465
augaagacuaucauugcuuugagcuacauucuaugucugguuuucgcucaaaaacuuccuggagaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuugaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaaaaagccaacaagcuguaauuccgaauaucggaucuagacccagaguaaggaauaucccuagcagaguaagcaucuauuggacaauaguaaaaccgggagauauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggauggaugguacgguuucaggcaucaaaauucugagggaaggggacaagcagcagaucucaaaagcacucaagcagcaaucgaucaaaucaaugggaagcugaauagauugaucgggaaaaccaucgagaaauuccaucagauugaaaaagaauuuucagaaguagaagggagaauucaggaccuugagaaauauguugaggacacuaaaauagaucucuggucauacaacgcggagcuucuuguugcccuggagaaccaccacgcaauugaucuaacugacucagaaaugaacaaacuguuugaaaaaacaaagaagcaaaugagggaaaaugcugaggauaugggcaaugguuguuucaaaauauaccucaaaugugacaaugccugcauaggaucaaucagaaauggaauuuaugaccacgauguguacagagaugaagcauuaaacaaccgauuccagaucaagggaguugagcugaagucaggguacaaagauuggauccuauggauuuccuuuaccgaaucauguuuucugcucuguguugcuuuguugggguucaucaugugggccugccaaaaaggcaacauuaggugcaacauuugcauuuga

SEQ ID NO: 42987 - RNA, 1701 nt, Artificial Sequence
  hemagglutinin__InfluenzaA__AID70466
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuugaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaaaaagccaacaagcuguaauuccgaauaucggaucuagacccagaguaaggaauaucccuagcagaguaagcaucuauuggacaauaguaaaaccgggagauauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggauggaugguacgguuucaggcaucaaaauucugagggaaggggacaagcagcagaucucaaaagcacucaagcagcaauugaucaaaucaaugggaagcugaauagauugaucgggaaaaccaucgagaaauuccaucagauugaaaaugaauucucagaagucgaagggagaauucaggaccuugagaaauauguugaggacacuaaaauagaucuuuggucauacaucggggagcuucuuguugcccuggagaaccaacacacaauugaucuaacugacucugaaaugaacaaacuguuugaaaaaacaaagaagcaacugagggaaaaugcugaggauaugggcaaugguuguuucaaaauauaccacaaaugugacaaugccugcauaggaucaaucagaaauggaauuuaugaccacgauguguacagagaugaagcauuaaacaaccgauuccagaucaagggaguugagcugaagucaggguacaaagauuggauccuauggauuuccuuugccauaucauguuuucugcucuguguugcuuuguugggguucaucaugugggccugccaaaaaggcaacauuaggugcaacauuugcauuuga

SEQ ID NO: 42988 - RNA, 1701 nt, Artificial Sequence
  hemagglutinin__InfluenzaA__AID70467
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuugaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaaaaagccaacaagcuguaauuccgaauaucggaucuagacccagaguaaggaauaucccuagcagaguaagcaucuauuggacaauaguaaaaccgggagauauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauugugagggaaggggacaagcagcagaucucaaaagcacucaagcagcaauugaucaaaucaaugggaagcugaauagauugaucgggaaaaccaucgagaaauuccaucagauugaaaaugaauucucagaagucgaagggagaauucagggccuugagaaauauguugaggacacuaaaauagaucuuuggucauauaucgcggagcuuauuguugcccuggagaaccaacacacaauugaucuaacugacucugaaaugaacaaacuguuugaaaaaacaaagaagcaaaugagggaaaaugcugaggauaugggcaaugguuguuucaaaauauaccacaaaugugacaaugccugcauaggaucaaucagaaauggaauuuaugaccacgauguguacagagaugaagcauuaaacaaccgauuccagaucaagggaguugagcugaagucaggguacaaagauuggauccuauggauuuccuuugccauaucauguuuucugcucuguguugcuuuguugggguucaucaugugggccugccaaaaaggcaacauuaggugcaacauuugcauuuga

SEQ ID NO: 42989 - RNA, 1701 nt, Artificial Sequence
  hemagglutinin__InfluenzaA__AID70468
augaagacuaucauugcuuugagcuacauucuaugucugguuuucgcucaaaagcuucccggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggauuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuugaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagauauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcuacaggaaugcgaaauguaccagagaaacaaacuagaggcauauuuggagcaauagcggguuucauagaaaaugguugggagggaaugguggauggaugguacgguuucaggcaucaaaauugugagggaaggggacaagcagcagaucucaaaagcacucaagcagcaauugaucaaaucaaugggaagcugaauagauugauggggaaauccaucgagaaauuccaucagauugaaaaugaauucucagaaguagaagggagaauucagggccuugagaaauauguugaggacacuaaaauagaucuuuggucauacaacggggagcuuauuguugcccuggagaaccaacacgcaauugaucuaacugacucugaaaugaacaaacuguuugaaaaaacaaagaagcaaaugagggaaaaugcugaggauaugggcaaugguuguuucaaaauauaccucaaaugugacaaugccugcauaggaucaaucagaaauggaauuuaugaccacgauguguacagagaugaagcauuaaacaaccgauuccagaucaagggaguugagcugaagucaggguacaaagauuggauccuauggauuuccuuuaccauaucauguuuucugcucuguguugcuuuguugggguucaucaugugggcccgccaaaaaggcaacauuaggugcaacauuugcauuuga

SEQ ID NO: 42990 - RNA, 1701 nt, Artificial Sequence
  hemagglutinin__InfluenzaA__AID70469
augaagacuaucauugcuuugagcuacauucuaugucugguuuucgcucaaaaaguucccggaaaugagaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggauuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuugaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagauauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauugugagggaaggggacaagcagcagaucucaaaagcacucaagcagcaauugaucaaaucaaugggaagcugaauagauugaucgggaaaaccaucgagaaauuccaucagauugaaaaagaauucucagaagucgaagggagaauucagggccuugagaaauauguugaggacacuaaaauagaucuuuggucauacaacgcggagcuucuuguugcccuggagaaccaacacacaauugaucuaacugacucagaaaugaacaaacuguuugaaaaaacaaagaagcaaaugagggaaaaugcugaggauaugggcaaugguuguuucaaaauauaccacaaaugugacaaugccugcauaggaucaaucagaaauggaauuuaugaccacgauguguacagagaugaagcauuaaacaaccgauuccagaucaagggaguugagcugaagucaggguacaaagauuggauccuauggauuuccuuuaccauaucauguuuucugcucuguguugcuuuguugggguucaucaugugggccugccaaaaaggcaacauuaggugcaacauuugcauuuga

SEQ ID NO: 42991 - RNA, 1701 nt, Artificial Sequence
  hemagglutinin__InfluenzaA__AID70470
augaagacuaucauugcuuugagcuacauucuaugucugguuuucgcucaaaagguucccggaaaugagaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggauuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuugaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagauauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggauggaugguacgguuucaggcaucaaaauugugagggaaggggacaagcagcagaucucaaaagcacucaagcagcaauugaucaaaucaaugggaagcugaauagauugaucgggaaaaccaucgagaaauuccaucagauugaaaaagaauucucagaagucgaagggagaauucagggccuugagaaauauguugaggacacuaaaauagaucuuuggucauacaacggggagcuucuuguugcccuggagaaccaccacacaauugaucuaacugacucugaaaugaacaaacuguuugaaaaaacaaagaagcaaaugagggaaaaugcugaggauaugggcaaugguuguuucaaaauauaccacaaaugugacaaugccugcauaggaucaaucagaaauggaauuuaugaccacgauguguacagagaugaagcauuaaacaaccgauuccagaucaagggaguugagcugaagucaggguacaaagauuggauccuauggauuuccuuuaccauaucauguuuucugcucuguguugcuuuguugggguucaucaugugggccugccaaaaaggcaacauuaggugcaacauuugcauuuga

SEQ ID NO: 42992 - RNA, 1701 nt, Artificial Sequence
  hemagglutinin__InfluenzaA__AID70471
augaagacuaucauugcuuugagcuacauucuaugucugguuuucacucaaaaacuucccggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuugaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaaaaagccaacaagcuguaauuccgaauaucggaucuagacccagaguaaggaauaucccuagcagaguaagcaucuauuggacaauaguaaaaccgggagauauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacuuugaaauuggcaacaggaaugcgaaauguaccagagaaacaaacuagaggcauauuuggcgcaauagcggguuucauagaaaaugguugggagggaaugguggaugguugguacgguuucagacaucaaaauucugagggaaggggacaagcagcagaucucaaaagcacucaagcagcaauugaucaaaucaaugggaagcugaauagauugaucgggaaaaccaucgagaaauuccaucagauugaaaaugaauucucagaagucgaagggagaauucaggaccuugagaaauauguugaggacacuaaaauagaucuuuggucauacaacgcggagcuuauuguugcccuggagaaccaccacacaauugaucuaacugacucugaaaugaacaaacuguuugaaaaaacaaagaagcaaaugagggaaaaugcugaggauaugggcaaugguuguuucaaaauauaccacaaaugugacaaugccugcauaggaucaaucagaaauggaauuuaugaccacgauguguacagagaugaagcauuaaacaaccgauuccagaucaagggaguugagcugaagucaggguacaaagauuggauccuauggauuuccuuugccauaucauguuuucugauuuguguugcuuuguugggguucaucaugugggcuugccaaaaaggcaaccuuaggugcaacauuugcauuuga

SEQ ID NO: 42993 - RNA, 1701 nt, Artificial Sequence
  hemagglutinin__InfluenzaA__AID70472
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuugaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaaaaagccaacaagcuguaauuccgaauaucggaucuagacccagaguaaggaauaucccuagcagaguaagcaucuauuggacaauaguaaaaccgggagauauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucagacaucaaaauucugagggaaggggacaagcagcagaucucaaaagcacucaagcagcaaucgaucaaaucaaugggaagcugaauagauugaucgggaaaaccaucgagaaauuccaucagauugaaaaagaauucucagaagucgaagggagaauucaggaccuugagaaauauguugaggacacuaaaauagaucucuggucauacaacgcggagcuucuuguugcccuggagaaccaccacacaauugaucuaacugacucagaaaugaacaaacuguuugaaaaaacaaagaagcaaaugagggaaaaugcugaggauaugggcaaugguuguuucaaaauauaccacaaaugugacaaugccugcauaggaucaaucagaaauggaauuuaugaccacgauguguacagagaugaagcauuaaacaaccgauuccagaucaagggaguugagcugaagucaggguacaaagauuggauccuauggauuuccuuugccauaucauguuuucugcucuguguugcuuuguugggguucaucaugugggccugccaaaaaggcaacauuaggugcaacauuugcauuuga

SEQ ID NO: 42994 - RNA, 1701 nt, Artificial Sequence
  hemagglutinin__InfluenzaA__AID70473
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuugaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaaaaagccaacaagcuguaauuccgaauaucggaucuagacccagaguaaggaauaucccuagcagaguaagcaucuauuggacaauaguaaaaccgggagauauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauugugagggaaggggacaagcagcagaucucaaaagcacucaagcagcaauugaucaaaucaaugggaagcugaauagauugaucgggaaaaccaucgagaaauuccaucagauugaaaaagaauucucagaagucgaagggagaauucagggccuugagaaauauguugaggacacuaaaauagaucucuggucauacaacgcggagcuucuuguugcccuggagaaccaacacacaauugaucuaacugacucugaaaugaacaaacuuuuugaaaaaacaaagaagcaaaugagggaaaaugcugaggauaugggcaaugguuguuucaaaauauaccacaaaugugacaaugccugcauaggaucaaucagaaauggaauuuaugaccacgauguguacagagaugaagcauuaaacaaccgauuccagaucaagggaguugagcugaagucaggguacaaagauuggauccuauggauuuccuuugccauaucauguuuuuugcucuguguugcuuuguugggguucaucaugugggccugccaaaaaggcaacauuaggugcaacauuugcauuuga

SEQ ID NO: 42995 - RNA, 1701 nt, Artificial Sequence
  hemagglutinin__InfluenzaA__AID70474
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuugaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaaaaagccaacaagcuguaauuccgaauaucggaucuagacccagaguaaggaauaucccuagcagaguaagcaucuauuggacaauaguaaaaccgggagauauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaauguuugggagggaaugguggauggaugguucgguuucagacaucaaauuugugagggaaggggacaagcagcgggucucgaaagcacucaagcagccauugaucaaaucaaugggaagaugaauagauugauggggaaaaccaucgggaaauuccaucagauuguaaaugaauucucagaagucgaagggagaauucaggaccuugagaaauauguugaggacacuaaaauagaucucuggucauacaucggggagcuucuuguugcccuugagaaccaccacgcaauugaucuaacugacucagaaaugaacaaacuguuugaaaaaacaaagaagcaaaugagggaaaaugcugaggauaugggcaaugguuguuucaaaauauaccacaaaugugacaaugccugcauaggaucaaucagaaauggaauuuaugaccgcgauguguacagagaugaagcauuaaacaaccgauuccacaucaagggaguugagcugaagucaggguacaaagauuggaucauauggauuuccucuaccgaaucauguuuuuugcucuguguugcuuuguugggguucaucaugugggcuugccaaaaaggcaacauuagaagcaacauuugcauuuga

SEQ ID NO: 42996 - RNA, 1701 nt, Artificial Sequence
  hemagglutinin__InfluenzaA__AID70475
augaagacuaucauugcuuugagcuacaugcuaugucugguguucgcucaaaaacuucccggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuugaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaaaaagccaacaagcuguaauuccgaauaucggaucuagacccagaguaaggaauaucccuagcagaguaagcaucuauuggacaauaguaaaaccgggagauauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggagcaauagcggguuucauagaaaauguuugggagggaaugguggaugguugguacgguuucaggcaucaaaauugugagggaaggggacaagcagcagaucucaaaagcgcucaagcagccauugauccaaucaaugggaagcugaauagauugauggggaaaaccaucgggaaauuccaccagauugaaaaagaauucucagaaguagaagggagaauucaggaccuugagaaauauguugaggacacuaaaauagaucuuuggucauacaacggggagcuucuuguugcccuggagaaccaacacgcaauugaucuaacugacucagaaaugaacaaaguguuugaaaaaacaaagaagcaacugagggaaaaugcugaggauaugggcaaugguuguuucaaaauauaccacaaaugugacaaugccugcauaggaucaaucagaaauggaauuuaugaucacgauguguacagaaaugaagcauuaaacaaccgauuccagaucaagggaguugagcugaagucaggguacaaagauuggauccuauggauuuccuuugccauaucauguuuucuucucaguguugcuucguugggguucaucaugugggccuaccaaaaaggcaacauuaggugcaacauuugcauuuga

SEQ ID NO: 42997 - RNA, 1701 nt, Artificial Sequence
  hemagglutinin__InfluenzaA__AID70476
augaagacuaucauugcuuugagcuacauucuaugucugguuuucgcucaaaaacuucccggaaaugaaaacagcacggcaacgcugggccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugaugacuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuugaacuucaaauacccagcauugaacgugacuaugccaaacaaugaacaauuugacaaauuguacauuugggggguucaccacccggguacggacaaggaccaaaucuuccuguaugcucaagcaucaggacgaaucacaguaucuaccaaaaaaagccaacaagcuguaauuccgaauaucggaucuagacccagaguaaggaauaucccuagcagaguaagcaucuauuggacaauaguaaaaccgggagauauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacaaucugaaauuggcuacaggaaugcgaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaauugaucaaaucaaugggaagcugaauagauugaucgggaaaaccaucgaaaaauuccaucagauugaaaaagaauucucagaaguagaagggagaauucagggccgugagaaauauguugaggacacuaaaauagaucuuuggucauacaucggggaguuuauuguugcccuggagaaccaacacacaauugaucuaacugacucugaaaugaacaaacuguuugaaaaaacaaagaagcaaaugagggaaaaugcugaggauaugggcaaugguuguuucaaaauauaccacaaaugugacaaugccugcauaggaucaaucagaaauggaauuuaugaccacgauguguacagagaugaagcguuaaacaaccgauuccagaucaagggaguugagcugaagucaggguacaaagauuggauccuauggauuuccuuugccauaucauguuuucugcucuguguugcuuuguugggguucaucaugugggccugccaaaaaggcaacauuaggugcaacauuugcauuuga

SEQ ID NO: 42998 - RNA, 1701 nt, Artificial Sequence
  hemagglutinin__InfluenzaA__AID70477
augaagacuaucauugcuuugagcuacauucuaugucugguuuucgcucaaaaacuuccuggaaaugacagcagcacgggaacgcugugccuugggcaccaugcagugccaaacggaacgauagugaaaacaaucacgaaugaccaaauugaaguuacuaaugcuacugagcugguucagaguuccucaacgggugaaauaugcaacaggccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguauauugaauugguugacccacuugaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaaaaagccaacaagcuguaauuccgaauaucggaucuagacccagaguaaggaauaucccuagcagaguaagcaucuauuggacaauaguaaaaccgggagagauacuuuugauuaacagcacagggaaucuaauugcuccuagggguuacuucaaaauacgaagugggaaaagcucaauaaugagaucagaugcacccauuggcaaaugcuauucugcaugcaucacuccaaauggaagcauucccaaugacaaaccauuccaaaauguaaacaggaucacauacggggccugucccagauauguuaagcaacacccucugaaauuggcaacaggaaugcgaaauguaccagagaaacaaacuagaggcauauuuggagcaauagcggguuucauagaaaaugguugggagggaaugguggauggaugguacgguuucaggcaucaaauuugugagggaaggggacaagcagcagaucucaaaagcacucaagcagcaauugaucaaaucaaugggaagcugaauagauugaucgggaaaaccaucgagaaauuccaucagauugaaaaagaauucucagaaguagaauggagaauucagggccuugagaaauauguugaggacacuaaaguagaucuuuggucauauaacggggagcuuauuguugcccuggagaaccaccacacaauugaucuaacugacucugaaaugaacaaacuguuugaaaaaacaaagaagcaaaugagggaaaaugcugaggauaugggcaaugguuguuucaaaauauaccucaaaugugacaaugccugcauaggaucaaucagaaauggaauuuaugaccacgauguguacagagaugaagcauuaaacaaccgauuccagaucaagggaguugagcugaagucaggguacaaagauuggauccuauggauuuccuuuaccgaaucauguuuucugcucaguguugcuuuguugggguucaucaugugggccugccaaaaaggcaacauuaggugcaacauuugcauuuga

SEQ ID NO: 42999 - RNA, 1701 nt, Artificial Sequence
  hemagglutinin__InfluenzaA__AID70478
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuugaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaaaaagccaacaagcuguaauuccgaauaucggaucuagacccagaguaaggaauaucccuagcagaguaagcaucuauuggacaauaguaaaaccgggagauauacuuuugauuaacagcacagggaaucuaauugcuccuagagguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggagcaauagcggguuucauagaaaaugguugggagggaaugguggauggaugguacgguuucaggcaucaaaauugugagggaaggggacaagcagcagaucucgaaagcacucaagcagcaauugaucaaaucaaugggaagaugaauagauugauggggaaaaccaucgagaaauuccaucagauugaaaaagaauuuucagaaguagaagggagaauucagggccgugagaaauauguugaggacacuaaaauagaucuuuggucauauaacggggagcuucuuguugaccuggagaaccaacacacaauugaucuaacugacucagaaaugaacaaaguguuugaaaaaacaaagaagcaaaugagggaaaaugcugaggauaugggcaaugguuguuucaaaauauaccacaaaugugacaaugccugcauaggaucaaucagaaauggaauuuaugaccacgauguguacagagaugaagcauuaaacaaccgauuccagaucaagggaguugagcugaagucaggguacaaagauuggauccaauggauuuccuuuaccauaucauguuuucugcucuguguuucuuuguugggguucaucaugugggcuugccaaaaaggcaacauuaggugcaacauuugcauuuga

SEQ ID NO: 43000 - RNA, 1701 nt, Artificial Sequence
  hemagglutinin__InfluenzaA__AID70632
augaaggcaauacuaguaguucugcuauauacauuugcaaccgcaaaugcagacacauuauguauagguuaucaugcgaacaauucaacagauacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacauguuacccaggagauuucaucaauuaugaggagcuaagagagcaauugagcucagugucaucauuugaaagguuugagauauuccccaagacgaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgaaggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43001 - RNA, 1683 nt, Artificial Sequence
  hemagglutinin__InfluenzaA__AID70634
augaacacucaaauccugguauucgcucugauugcgaucauuccaacaaaugcagacaaaaucugccucggacaucaugccgugucaaacggaaccaaaguaaacacauuaacugaaagaggaguggaagucgucaaugcaacugaaacaguggaacgaacaaacauccccaggaucugcucaaaagggaaaaggacaguugaccucggucaauguggacuccuggggacaaucacuggaccaccucaaugugaccaauuccuagaauuuucagccgauuuaauuauugagaggcgagaaggaagugaugucuguuauccugggaaauucgugaacgaagaagcucugaggcaaauucucagagaaucaggcggaauugacaaggaagcaaugggauucacauacaguggaauaagaacuaauggagcaaccagugcauguaggagaucaggaucuucauucuaugcagaaaugaaauggcuccugucaaacacagauaaugcugcauucccgcagaugacuaagucauauaaaaauacaagaaaaagcccagcucuaauaguauggggaauccaucauuccgugucaacugcagagcaaaccaagcuauaugggaguggaaacaaacuggugacagucgggaguucuaauuaucaacaaucuuuuguaccgaguccaggagcgagaccacaaguuaauggucuaucuggaagaauugacuuucauuggcuaaugcuaaaucccaaugauacagucacuuucaguuucaauggggcuuucauagcuccagaccgugcaagcuuccugagaggaaaaucuaugggaauccagaguggaguacagguugaugccaauugugaaggggacugcuaucauaguggagggacaauaauaaguaacuugccauuucagaacauagauagcagagcaguuggaaaauguccgagauauguuaagcaaaggagucugcugcuagcaacagggaugaagaauguuccugagauuccaaagggaagaggccuauuuggugcuauagcggguuucauugaaaauggaugggaaggccuaauugaugguugguaugguuucagacaccagaaugcacagggagagggaacugcugcagauuacaaaagcacucaaucggcaauugaucaaauaacaggaaaauuaaaccggauuauagaaaaaaccaaccaacaauuugaguugauagacaaugaauucaaugagguagagaagcaaaucaguaaugugauaaauuggaccagagauucuauaacagaaguguggucauacaaugcugaacucuugguagcaauggagaaccagcauacaauugaucuggcugauucagaaauggacaaacuguacgaacgagugaaaagacagcuaagagagaaugcugaagaagauggcacugguugcuuugaaauauuucacaagugugaugaugacuguauggccaguauuagaaauaacaccuaugaucacagcaaauacagggaagaggcaaugcaaaauagaauacagauugacccagucaaacuaagcagcggcuacaaagaugugauacuuugguuuagcuucggggcaucauguuucauacuucuagccauuguaaugggccuugucuucauauguguaaagaauggaaacaugcggugcacuauuuguauauaa

SEQ ID NO: 43002 - RNA, 1701 nt, Artificial Sequence
  hemagglutinin__InfluenzaA__AIF72902
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucagcaggugaaauaugcgacaguccucaucagauccuugauggagaaaacugcacacuaauagaugcucuauugggagacccucagugugauggcuuccaaaauaagaaaugggaccuuuuuguugaacgaagcagagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauucggcgcaauagcggguuucauagaaaaugguugggagggaaugguggaugguugguacgguuucaggcaucaaaauucugagggaagaggacaagcagcagaucucaaaagcacucaagcagcaaucgaucaaaucaauggaaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43003 - RNA, 1701 nt, Artificial Sequence
  hemagglutinin__InfluenzaA__AIF72903
augaagacuaucauugcuuugagcuacauucuaugucugguuuucgcucaagaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucagcaggugaaauaugcgacaguccucaucagauccuugauggagaaaacugcacacuaauagaugcucuauugggagacccucagugugauggcuuccaaaauaagaaaugggaccuuuuuguugaacgaagcagagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaauggaaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggguccuauggauuuccuuugccauaucauguuuuuugcuuuguguugcuuuguugggguucaucaugugggccugccaaaaaggcaacauuaggugcaacauuugcauuuga

SEQ ID NO: 43004 - RNA, 1701 nt, Artificial Sequence
  hemagglutinin__InfluenzaA__AIF72904
augaagacuaucauugcuuugagcuacauucuaugucugguuuucgcucaagaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucagcaggugaaauaugcgacaguccucaucagauccuugauggagaaaacugcacacuaauagaugcucuauugggagacccucagugugauggcuuccaaaauaagaaaugggaccuuuuuguugaacgaagcagagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaauggaaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggguccuauggauuuccuuugccauaucauguuuuuugcuuuguguugcuuuguugggguucaucaugugggccugccaaaaaggcaacauuaggugcaacauuugcauuuga

SEQ ID NO: 43005 - RNA, 1701 nt, Artificial Sequence
  hemagglutinin__InfluenzaA__AIF72905
augaagacuaucauugcuuugagcuacauucugugucugguuuucgcucaaaaacuuccuggaaaugacaacagcacggcaacgcugugccuugggcaccaugcaguaccaaacggaacgauagugaaaacaaucacgaaugaccaaauugaaguuacuaaugccacugagcugguucagaguuccucagcaggugaaauaugcgacaguccucaucagauccuugauggagaaaacugcacacuaauagaugcucuauugggagacccucagugugauggcuuccaaaauaagaaaugggaccuuuuuguugaacgaagcagagccuacagcaacuguuacccuuaugaugugccggauuaugccucccuuaggucacuaguugccucauccggcacacuggaguuuaaaaaugaaaguuucaauuggacuggagucacucaaaacggaacaagcucugcuugcauaaggagaucuaauaauaguuucuuuaguagauugaauugguugacccacucaaacuucaaauacccagcauugaacgugacuaugccaaacaaugaacaauuugacaaauuguacauuugggggguucaccacccggguacagacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuuuaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauucggcgcaauagcggguuucauagaaaaugguugggagggaaugauggaugguugguacgguuucaggcaucaaaauucugagggaagaggacaagcagcagaucucaaaagcacucaagcagcaaucgaucaaaucaauggaaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43006 - RNA, 1701 nt, Artificial Sequence
  hemagglutinin__InfluenzaA__AIF72906
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugaacugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugaacugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43007 - RNA, 1701 nt, Artificial Sequence; identical to SEQ ID NO: 34103
  hemagglutinin__InfluenzaA__AIF72907

SEQ ID NO: 43008 - RNA, 1701 nt, Artificial Sequence; identical to SEQ ID NO: 34103
  hemagglutinin__InfluenzaA__AIF72908

SEQ ID NO: 43009 - RNA, 1701 nt, Artificial Sequence
  hemagglutinin__InfluenzaA__AIF72909
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucagcaggugaaauaugcgacgguccucaucagauccuugauggagaaaacugcacacuaauagaugcucuauugggagacccucagugugauggcuuccaaaauaagaaaugggaccuuuuuguugaacgaagcagagccuacagcaacuguuacccuuaugaugugccggauuaugccucccuuaggucacuaguugccucauccggcacacuggaguuuaacaaugaaagcuucaauuggacuggaaccacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaauggaaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43010 - RNA, 1701 nt, Artificial Sequence
  hemagglutinin__InfluenzaA__AIF72910
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuaggggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43011 - RNA, 1701 nt, Artificial Sequence
  hemagglutinin__InfluenzaA__AIF72911
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugacggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacagugucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43012 - RNA, 1701 nt, Artificial Sequence
  hemagglutinin__InfluenzaA__AIF72912
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucagcaggugaaauaugcgacaguccucaucagauccuugauggagaaaacugcacacuaauagaugcucuauugggagacccucagugugauggcuuccaaaauaagaaaugggaccuuuuuguugaacgaagcagagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaauggaaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43013 - RNA, 1701 nt, Artificial Sequence; identical to SEQ ID NO: 34103
  hemagglutinin__InfluenzaA__AIF72913

SEQ ID NO: 43014 - RNA, 1701 nt, Artificial Sequence
  hemagglutinin__InfluenzaA__AIF72914
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaggugggaaaagcucaauaaugagaucagaugcacccauuggcaaaugcaauucugaaugcaucacuccaaauggaagcauucccaaugacaaaccauuccaaaauguaaacaggaucacauauggggccugucccagauauguuaagcaaaacacucugaaauuggcaacaggaaugcgaaauguaccagagaaacaaacuagaggcauauuuggcgcaauagcggguuucauagaaaaugguugggagggaaugguggacgguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaggucgaagggagaauucacgaccuugagaaauauguugaggacacuuuauucgaucucuggguauacaacucggagcuucuuguugcccugcagaaccaacauacaauugaucuaccugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43015 - RNA, 1701 nt, Artificial Sequence
  hemagglutinin__InfluenzaA__AIF72915
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucuucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucaucaggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucaaaugcacccauuggcaaaugcaauucugaaugcauuacuccaaauggaagcauucccaaugacaaaccauuccaaaauguaaacaggaucacauacggugccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43016 - RNA, 1701 nt, Artificial Sequence
  hemagglutinin__InfluenzaA__AIF72916
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaauagaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcuaaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43017 - RNA, 1701 nt, Artificial Sequence
  hemagglutinin__InfluenzaA__AIF72917
augaagacuaucauugcuuugagcuacauucuaugucugguuuucgcucaaaaacuuccuagaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaaaaaugaaagcuucaauuggacuggagucacucaaaacggaacaagcucugcuugcauaaggagaucuaauaauaguuucuuuaguagauugaacugguugacccacuuaaacuucaaauacccagcauugaacgugacuaugccaaacaaugaacaauuugacaaacuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugagaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggauacaaagauuggauccuauggauuuccuuugccauaucauguuuuuugcuuuguguugcuuuguugggguucaucaugugggccugccaaaaaggcaacauuaggugcgacauuugcauuuga

SEQ ID NO: 43018 - RNA, 1683 nt, Artificial Sequence
  hemagglutinin__InfluenzaA__AIG44693
auggagacagcaucacugauaacuauacuacuaguaguaacaguaagcaaugcagauaagaucugcaucggcuaucaaucaacaaacuccacagaaacuguagacacacuaacagaaaacaaugucccugugacacaugccaaagaacugcuccacacagagcauaaugggaugcugugugcaacaagcuugggacaaccucuuauucuagacacuuguaccauugaaggacuaaucuacggcaauccuucuugugaucuauuguugggaggaagagaaugguccuauaucgucgagagaccaucagcuguuaacggauuguguuaucccgggaauguugaaaaucuagaagagcuaaggucacucuuuaguucugcuaggucuuaucaaaggauccagauuuucccagacacaaucuggaaugugucuuacagugggacaagcaaagcauguucagauucauucuacagaagcaugagaugguugacucaaaaggacaacgcuuacccuauucaagacgcccaauacacaaauaaucaagaaaagaacauucuuuucauguggggcauaaaucacccacccacugauacugcacagacaaaucuguacacaagaaccgacacaacaacgaguguggcaacagaagaaauaaauaggaccuucaaaccauugauaggaccaaggccucuuguccacgguuugaugggaagaauuaauuauuauuggucgguauuaaaaccgggucaaacacugcgaauaaaaucuaauggaaaucuaauagcuccaugguauggacacauucucucaggaaagagccacgggagaauccugaagacugauuuaaaaagagguaacugcacagugcaaugucagacagagaaggguggcuuaaacacaacauugccauuccaaaaugugaguaaguaugcauuuggaaacuguucgaaauacauuggcauaaagagucucaaacuugcaguuggucugaggaaugugccuucuagaucuaguagaggacuauucggggccauagcaggauucauagagggagguuggucaggacuaguugcugguugguauggauuccagcauucaaaugaccaagggguugguauggcagcagauagagacucaacccaaaaggcaauugauaaaauaacauccaaagugaauaacauagucgacaaaaugaacaagcaguaugaaauuaucgaucaugaauucagcgagguugaaacuagacuuaacaugauuaauaauaagauugaugaucaaauccaagauauaugggcauauaaugcagaauugcuaguucugcuugaaaaccagaaaacacucgaugagcaugaugcaaauguaaacaauuuguacaauaaagugaagagggcguuggguuccaaugcgguggaagaugggaaaggauguuucgagcuauaccacaaaugugaugaccagugcauggagacaauucggaacgggaccuacaacagaaggaaguaucaagaggagucaaaauuagaaaaacagaaaauagagggggucaagcuggaaucugaaggaacuuacaaaauccucaccauuuauucgacugucgccucaucucuugugauugcaaugggguuugcugccuucuuguucugggccauguccaaugggucuugcagaugcaacauuuguauauaa

SEQ ID NO: 43019 - RNA, 1701 nt, Artificial Sequence
  hemagglutinin__InfluenzaA__AIJ10728
augaagacuaucauugcuuugagcuacauucuaugucugguuuucgcucaaaaacuuccuggaaaugacaacagcacggcaacgcugugccuugggcaccaugcagugccaaacggaacaauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuugaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagauauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcuaaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43020 - RNA, 1701 nt, Artificial Sequence
  hemagglutinin__InfluenzaA__AIJ10729
augaagacuaucauugcuuugagcuacauucuaugucugguuuucgcucaaaaacuuccuggacaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuaaaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43021 - RNA, 1701 nt, Artificial Sequence
  hemagglutinin__InfluenzaA__AIJ10730
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggggaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43022 - RNA, 1701 nt, Artificial Sequence; identical to SEQ ID NO: 41100
  hemagglutinin__InfluenzaA__AIJ10731

SEQ ID NO: 43023 - RNA, 1701 nt, Artificial Sequence
  hemagglutinin__InfluenzaA__AIJ10732
augaagacuaucauugcuuugagcuacauucuaugucugguuuucgcucaagaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucagauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43024 - RNA, 1701 nt, Artificial Sequence
  hemagglutinin__InfluenzaA__AIJ10733
augaagacuaucauugcuuugagcuacauucuaugucugguuuucgcucaagaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucagauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagauauacuuuugauuaacagcacagggaaucuaauugcuccuagggguuacuucaaaauacgaagugggaaaagcucaauaaugagaucagaugcacccauuggcaaaugcaaaucugcaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaaugcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucgaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcucuguugggguucaucaugugggccugccaaaaaggcaacauuaggugcaacauuugcauuuga

SEQ ID NO: 43025 - RNA, 1701 nt, Artificial Sequence
  hemagglutinin__InfluenzaA__AIJ10734
augaagacuaucauugcuuugagcuacauucuaugucugguuuucgcucaaaaacuuccugaaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuauacauuugggggguucaccacccggguacggacaaggaccaaaucuuccuguaugcucaagcaucaggaagaaucacaguaucuaccaaaagaagccaacaagcuguaauuccgaauauaggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucuacaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaaccuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43026 - RNA, 1701 nt, Artificial Sequence
  hemagglutinin__InfluenzaA__AIJ10735
augaagacuaucauugcuuugagcuacauucuaugucugauuuucgcucaaaaacuuccugaaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuauacauuugggggguucaccacccggguacggacaaagaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucuacaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaagggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaaccuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43027 - RNA, 1701 nt, Artificial Sequence
  hemagglutinin__InfluenzaA__AIJ10736
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccacaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacauuggaguuuaacaaugaaagcuucaauuggacuggagucacucaaaacggaacaaguucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43028 - RNA, 1701 nt, Artificial Sequence
  hemagglutinin__InfluenzaA__AIJ10737
augaagacuaucauugcuuugagcuacauucuaugucugguugucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucaaauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaaugagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43029 - RNA, 1701 nt, Artificial Sequence
  hemagglutinin__InfluenzaA__AIJ10738
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacuuaaacuucaaauacccagcauugaacgugacuaugccaaacaaugaacauuuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagagaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43030 - RNA, 1701 nt, Artificial Sequence
  hemagglutinin__InfluenzaA__AIJ10740
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugauguaccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugaucaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagagaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43031 - RNA, 1701 nt, Artificial Sequence
  hemagglutinin__InfluenzaA__AIJ10741
augaagacuaucauugcuuugagcuacauucuaugucugguuuucgcucaaaaacuuccuggaaaugacaauagcacggcaacguugugccuugggcaccaugcaguaccaaauggaacgauagugaaaacaaucacgaaugaccgaauugaaguuacuaaugcuacugagcugguucagaauuccucaauaggugaaauaugcgacaguccccaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagagaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43032 - RNA, 1701 nt, Artificial Sequence
  hemagglutinin__InfluenzaA__AIJ10742
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguagcuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcacuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43033 - RNA, 1701 nt, Artificial Sequence
  hemagglutinin__InfluenzaA__AIJ10743
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggaggggaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacauuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43034 - RNA, 1701 nt, Artificial Sequence
  hemagglutinin__InfluenzaA__AIJ10744
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagaacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43035 - RNA, 1701 nt, Artificial Sequence; identical to SEQ ID NO: 40522
  hemagglutinin__InfluenzaA__AIJ10745

SEQ ID NO: 43036 - RNA, 1701 nt, Artificial Sequence
  hemagglutinin__InfluenzaA__AIJ10747
augaagaccaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggggacccucagugugaugacuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaaacuucaauuggacuggagucacucaaaacggaacaaguucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacugggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaaaucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43037 - RNA, 1701 nt, Artificial Sequence
  hemagglutinin__InfluenzaA__AIJ10748
augaagaccaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugaugacuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaaacuucaauuggacuggagucacucaaaacggaacaaguucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacugggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaaaucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43038 - RNA, 1701 nt, Artificial Sequence
  hemagglutinin__InfluenzaA__AIJ10750
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugauguaccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaauaagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43039 - RNA, 1701 nt, Artificial Sequence
  hemagglutinin__InfluenzaA__AIJ10752
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaauuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccuaauaucggaucuagacccagaauaaggaauaucccuaguagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugauucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccaugucauguuuuuugcuuuguguugcuuuguugggguucaucaugugggccugccaaaagggcaacauuaggugcaacauuugcauuuga

SEQ ID NO: 43040 - RNA, 1701 nt, Artificial Sequence
  hemagglutinin__InfluenzaA__AIJ10753
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucaaauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucuucuugcauaaggggaucuaauaauaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43041 - RNA, 1701 nt, Artificial Sequence
  hemagglutinin__InfluenzaA__AIJ10754
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcuuugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaucgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43042 - RNA, 1701 nt, Artificial Sequence
  hemagglutinin__InfluenzaA__AIJ10755
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaaagaagcaaagccuacagcaacuguuacccuuaugaugugccggacuaugccucccuuagaucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcauuuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggugccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaaucagcaaucgaucaaaucaauggaaagcugaaccgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43043 - RNA, 1701 nt, Artificial Sequence
  hemagglutinin__InfluenzaA__AIJ10756
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43044 - RNA, 1701 nt, Artificial Sequence
  hemagglutinin__InfluenzaA__AIJ10757
augaagacuaucauugcuuugagcuacauucuaugucugguuaucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguuguuuuguugggguucaucaugugggccugccaaaagggcaacauuaggugcaacauuugcauuuga

SEQ ID NO: 43045 - RNA, 1701 nt, Artificial Sequence
  hemagglutinin__InfluenzaA__AIJ10758
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43046 - RNA, 1701 nt, Artificial Sequence
  hemagglutinin__InfluenzaA__AIJ10759
augaagacuaucauugcuuugagcuacauucuaugucugguuuuugcucaaaaacuuccuggaaaugacaauagcacggcaacgcugugccuugggcaccaugcaguaccaaauggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacggagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaccuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43047 - RNA, 1701 nt, Artificial Sequence
  hemagglutinin__InfluenzaA__AIJ10760
augaagacuaucauugcuuugagcuacauucuaugucugguuaucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucugacugacucagaaaugaacaaacuguucgaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43048 - RNA, 1701 nt, Artificial Sequence
  hemagglutinin__InfluenzaA__AIJ10761
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaagaaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaauuaaugggaagcugaaucgauugaucgggaaaaccaacgagaaauuccaucagauugaaaaagaauucucagaaguagaagggagaauucaggaucuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacaggaaugaagcauuaaacaaacgguuccagaucaagggaguugagcugaagucaggguacaaagauuggauccuauggauuuccuuugccauaucauguuuuuugcuuuguguuguuuuguugggguucaucaugugggccugccaaaagggcaacauuaggugcaacauuugcauuuga

SEQ ID NO: 43049 - RNA, 1701 nt, Artificial Sequence
  hemagglutinin__InfluenzaA__AIJ10762
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaagggggucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuuuaaaauacgaagugggaaaagcucaauaaugagaucagaugcacccauuggcaaaugcaagucugaaugcaucacuccaaauggaagcauuccuaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguuguuuuguugggguucaucaugugggccugccaaaagggcaacauuaggugcaacauuugcauuuga

SEQ ID NO: 43050 - RNA, 1701 nt, Artificial Sequence
  hemagglutinin__InfluenzaA__AIJ10763
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaccaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuacuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguuguuuuguugggguucaucaugugggccugccaaaagggcaacauuaggugcaacauuugcauuuga

SEQ ID NO: 43051 - RNA, 1701 nt, Artificial Sequence
  hemagglutinin__InfluenzaA__AIJ10764
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaagaaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaauuaaugggaagcugaaucgauugaucgggaaaaccaacgagaaauuccaucagauagaaaaagaauucucagaaguagaagggagaauucaggaucuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguuguuuuguugggguucaucaugugggccugccaaaagggcaacauuaggugcaacauuugcauuuga

SEQ ID NO: 43052 - RNA, 1701 nt, Artificial Sequence
  hemagglutinin__InfluenzaA__AIJ10765
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaagggggucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguuguuuuguugggguucaucaugugggccugccaaaagggcaacauuaggugcaacauuugcauuuga

SEQ ID NO: 43053 - RNA, 1701 nt, Artificial Sequence; identical to SEQ ID NO: 43050
  hemagglutinin__InfluenzaA__AIJ10766

SEQ ID NO: 43054 - RNA, 1701 nt, Artificial Sequence
  hemagglutinin__InfluenzaA__AIJ10767
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaccaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuacuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgauuccagaucaagggaguugagcugaagucaggguacaaagauuggauccuauggauuuccuuugccauaucauguuuuuugcuuuguguuguuuuguugggguucaucaugugggccugccaaaagggcaacauuaggugcaacauuugcauuuga

SEQ ID NO: 43055 - RNA, 1701 nt, Artificial Sequence
  hemagglutinin__InfluenzaA__AIJ10768
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaagaaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauauaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaauuaaugggaagcugaaucgauugaucgggaaaaccaacgagaaauuccaucagauugaaaaagaauucucagaaguagaagggagaauucaggaucuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguuguuuuguugggguucaucaugugggccugccaaaagggcaacauuaggugcaacauuugcauuuga

SEQ ID NO: 43056 - RNA, 1701 nt, Artificial Sequence
  hemagglutinin__InfluenzaA__AIJ10769
augaagacuaucauugcuuugagcuacauucuaugucugguuuucgcucaaaaacuuccuggaaaugacaauagcacggcaacacugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaagggggucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguuguuuuguugggguucaucaugugggccugccaaaagggcaacauuaggugcaacauuugcauuuga

SEQ ID NO: 43057 - RNA, 1701 nt, Artificial Sequence; identical to SEQ ID NO: 43054
  hemagglutinin__InfluenzaA__AIJ10770

SEQ ID NO: 43058 - RNA, 1701 nt, Artificial Sequence; identical to SEQ ID NO: 43051
  hemagglutinin__InfluenzaA__AIJ10771

SEQ ID NO: 43059 - RNA, 1701 nt, Artificial Sequence
  hemagglutinin__InfluenzaA__AIJ10772
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaccaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuacuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguuguuuuguugggguucaucaugugggccugccaaaagggcaacauuaggugcaacauuugcauuuga

SEQ ID NO: 43060 - RNA, 1701 nt, Artificial Sequence
  hemagglutinin__InfluenzaA__AIJ10773
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccauuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaccaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguuguuuuguugggguucaucaugugggccugccaaaagggcaacauuaggugcaacauuugcauuuga

SEQ ID NO: 43061 - RNA, 1701 nt, Artificial Sequence
  hemagglutinin__InfluenzaA__AIJ10774
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcaacaguccucaucagauccuugauggagaaaacugcacacuaauagaugcucuauugggagacccucagugugauggcuuucaaaauaagaaaugggaccuuuuuguugaacggagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguccaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaaucagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguuguuuuguugggguucaucaugugggccugccaaaagggcaacauuaggugcaacauuugcauuuga

SEQ ID NO: 43062 - RNA, 1701 nt, Artificial Sequence
  hemagglutinin__InfluenzaA__AIJ10776
augaagacuaucauugcuuugagcugcauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucagggagaaucacaguaucuaccaaaagaagccaacaagcuguaaucccgaauaucggaucuagacccagaauaagaaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccgaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaauuaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugagcaaacuguuugaaaaaacaaaaaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguuguuuuguugggguucaucaugugggccugccaaaagggcaacauuaggugcaacauuugcauuuga

SEQ ID NO: 43063 - RNA, 1701 nt, Artificial Sequence
  hemagglutinin__InfluenzaA__AIJ10777
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuagcaacaggaaugcgaaauguaccagagaaacaaacuagaggcauauuuggcgcaauagcggguuucauagaaaaugguugggagggaaugguggaugguugguacgguuucaggcaccaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguuguuuuguugggguucaucaugugggccugccaaaagggcaacauuaggugcaacauuugcauuuga

SEQ ID NO: 43064 - RNA, 1701 nt, Artificial Sequence; identical to SEQ ID NO: 43060
  hemagglutinin__InfluenzaA__AIJ10778

SEQ ID NO: 43065 - RNA, 1701 nt, Artificial Sequence
  hemagglutinin__InfluenzaA__AIJ10780
augaagacuaucauugcuuugagcuacauucuaugucugguuuucgcucaaaaacuuccuggaaaugacaauagcacagcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauagcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggacauugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43066 - RNA, 1701 nt, Artificial Sequence; identical to SEQ ID NO: 43063
  hemagglutinin__InfluenzaA__AIJ10781

SEQ ID NO: 43067 - RNA, 1701 nt, Artificial Sequence
  hemagglutinin__InfluenzaA__AIJ10782
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaccaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguuguuuuguugggguucaucaugugggccugccaaaagggcaacauuaggugcaacauuugcauuuga

SEQ ID NO: 43068 - RNA, 1701 nt, Artificial Sequence
  hemagglutinin__InfluenzaA__AIJ10783
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggguuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggaaggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugaaaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43069 - RNA, 1701 nt, Artificial Sequence
  hemagglutinin__InfluenzaA__AIJ10784
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggguuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggaaggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugaaaaauauguugaggacacaaaaauagaucuuuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43070 - RNA, 1701 nt, Artificial Sequence
  hemagglutinin__InfluenzaA__AIJ10785
augaagacuaucauugcuuugagcuacauucuaugucugguuuucgcucaaaaacuuccaggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcaacaguccucaucagauccuugauggagaaaacugcacacuaauagaugcucuauugggagacccucagugugauggcuuucaaaauaagaaaugggaccuuuuuguugaacggagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguccaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaaucagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43071 - RNA, 1701 nt, Artificial Sequence; identical to SEQ ID NO: 43068
  hemagglutinin__InfluenzaA__AIJ10786

SEQ ID NO: 43072 - RNA, 1701 nt, Artificial Sequence
  hemagglutinin__InfluenzaA__AIJ10787
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggguuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggaaggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggaggauucaggaccuugaaaaauauguugaggacacaaaaauagaucuuuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccggaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43073 - RNA, 1701 nt, Artificial Sequence
  hemagglutinin__InfluenzaA__AIJ10788
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcaacaguccucaucagauccuugauggagaaaacugcacacuaauagaugcucuauugggagacccucagugugauggcuuucaaaauaagaaaugggaccuuuuuguugaacggagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguccaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaaucagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43074 - RNA, 1701 nt, Artificial Sequence; identical to SEQ ID NO: 43073
  hemagglutinin__InfluenzaA__AIJ10789

SEQ ID NO: 43075 - RNA, 1701 nt, Artificial Sequence
  hemagglutinin__InfluenzaA__AIJ10790
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggguuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggaaggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugaaaaauauguugaggacacaaagauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43076 - RNA, 1701 nt, Artificial Sequence
  hemagglutinin__InfluenzaA__AIJ10791
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaauuccgaauaucggaucuagacccagaauaaggaauaucccuagcagaauaagcaucuacuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaccaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuacuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgauuccagaucaagggaguugagcugaagucaggguacaaagauuggauccuauggauuuccuuugccauaucauguuuuuugcuuuguguuguuuuguugggguucaucaugugggccugccaaaagggcaacauuaggugcaacauuugcauuuga

SEQ ID NO: 43077 - RNA, 1701 nt, Artificial Sequence
  hemagglutinin__InfluenzaA__AIJ10792
augaagacuaucauugcuuugagcuacauucuaugucugguuuucgcucaaaaacuuccuggagaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaagggggucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaacaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguuguuuuguugggguucaucaugugggccugccaaaagggcaacauuaggugcaacauuugcauuuga

SEQ ID NO: 43078 - RNA, 1701 nt, Artificial Sequence
  hemagglutinin__InfluenzaA__AIJ29347
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucauaaugugggccugccaaaagggcaacauuaggugcaacauuugcauuuga

SEQ ID NO: 43079 - RNA, 1701 nt, Artificial Sequence
  hemagglutinin__InfluenzaA__AIJ29349
augaagacuaucauugcuuugagcuacauucuaugucugguuuucgcucaaaaauuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucugauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43080 - RNA, 1701 nt, Artificial Sequence
  hemagglutinin__InfluenzaA__AIJ29351
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagauccaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagggaugaagcauuaaacaaccgguuccagaucaagggaguugagcugaagucaggguacaaagauuggauccuauggauuuccuuugccauaucaugucuuuugcuuuguguugcuuuguugggguucaucaugugggccugccaaaagggcaacauuaggugcaacauuugcauuuga

SEQ ID NO: 43081 - RNA, 1701 nt, Artificial Sequence
  hemagglutinin__InfluenzaA__AIJ29353
augaagacuaucauugcuuugagcuacauucuaugucugguuuucgcucaaaaacuuccugaaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuauacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucuacaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggucaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaaccuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43082 - RNA, 1701 nt, Artificial Sequence
  hemagglutinin__InfluenzaA__AIJ29355
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccucaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccagcaagcuguaaucccgaauaucggaucuagauccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccucgagaaauacguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43083 - RNA, 1701 nt, Artificial Sequence
  hemagglutinin__InfluenzaA__AIJ29357
augaagacuaucauugcuuugagcuacauucuaugucugguuuucgcucaaaaacuuccuggaaaugacaacagcacugcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccagcaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaaacugaaucgauugaucgggaaaaccaacgagaaauuccaucagauugaaaaagaauucucagaagucgaagggagaauucaggaccucgagaaauacguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaaaggaguugagcugaagucaggguacaaagauuggauccuauggauuuccuuugccauaucauguuuuuugcuuuguguugccuuguugggguucaucaugugggcuugccaaaagggcaacauuaggugcaacauuugcauuuga

SEQ ID NO: 43084 - RNA, 1701 nt, Artificial Sequence
  hemagglutinin__InfluenzaA__AIJ29359
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccucgagaaauacguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcaauaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43085 - RNA, 1701 nt, Artificial Sequence
  hemagglutinin__InfluenzaA__AIJ29361
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugucucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43086 - RNA, 1701 nt, Artificial Sequence
  hemagglutinin__InfluenzaA__AIL93623
augaaggcaauacuaguaguucugcuauauacauuugcaaccgcaaaugcagacacauuauguauagguuaucaugcgaacaauucaacagacacuguagauacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauccaccauccaucuacuacugcugaccaacaaagucucuaucagaaugcagaugcauauguuuuuguggggacaucaagauacagcaaaaaguucaagccggaaauagcaauaagacccaaagugagggaucaagaagggagaaugaacuauuacuggacacuaguagagccaggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaauguagaauauguauuuaa

SEQ ID NO: 43087 - RNA, 1701 nt, Artificial Sequence
  hemagglutinin__InfluenzaA__AIL93634
augaaggcaauacuaguaguucuacuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauccaccauccaucuacuacugcugaccaacaaagucucuaucagaaugcagaugcauauguuuuuguggggacaucaagauacagcaaaaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaaguacaaaauugagacuggccacaggauugaggaaugucccgucuauucaaucuagaggccuauucggggccauugccggcuucauugaagggggguggacagggaugguagauggaugguacgguuaucaccaccaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcaauaacacgugcauggaaagugucaagaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaauguagaauauguauuuaa

SEQ ID NO: 43088 - RNA, 1701 nt, Artificial Sequence
  hemagglutinin__InfluenzaA__AIL93645
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaucgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucagauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaggcauugaacaaccgguuccagaucaagggaguugaguugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43089 - RNA, 1701 nt, Artificial Sequence; identical to SEQ ID NO: 40647
  hemagglutinin__InfluenzaA__AIL93657

SEQ ID NO: 43090 - RNA, 1701 nt, Artificial Sequence; identical to SEQ ID NO: 40647
  hemagglutinin__InfluenzaA__AIL93669

SEQ ID NO: 43091 - RNA, 1701 nt, Artificial Sequence
  hemagglutinin__InfluenzaA__AIL93681
augaaggcaauacuaguaguucuacuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccuggggaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucuuacccaaagcucagccaauccuacauuaaugauaaagggaaagaaguccucgugcuguggggcauccaccauccaucuacuacugcugaccaacaaagucucuaucagaaugcagaugcauauguuuuuguggggacaucaagauacagcaaaaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaagugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagacggaugguacgguuaucaccaccaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuugaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaagaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaauguagaauauguauuuaa

SEQ ID NO: 43092 - RNA, 1701 nt, Artificial Sequence; identical to SEQ ID NO: 43088
  hemagglutinin__InfluenzaA__AIL93692

SEQ ID NO: 43093 - RNA, 1701 nt, Artificial Sequence; identical to SEQ ID NO: 43088
  hemagglutinin__InfluenzaA__AIL93716

SEQ ID NO: 43094 - RNA, 1701 nt, Artificial Sequence; identical to SEQ ID NO: 40647
  hemagglutinin__InfluenzaA__AIL93728

SEQ ID NO: 43095 - RNA, 1701 nt, Artificial Sequence
  hemagglutinin__InfluenzaA__AIL93740
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaggcauugaacaaccgguuccagaucaagggaguugaguugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43096 - RNA, 1701 nt, Artificial Sequence
  hemagglutinin__InfluenzaA__AIL93752
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacagaccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaaaaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaggcauugaacaaccgguuccagaucaagggaguugaguugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43097 - RNA, 1701 nt, Artificial Sequence
  hemagglutinin__InfluenzaA__AIL93764
augaagacuaucauugcuuugagcuacauucuaugucugguuuucacucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaaugaaacuuaugaccacgauguauacagggaugaagcauuaaacaaccgguuccagaucaagggaguugaguugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43098 - RNA, 1701 nt, Artificial Sequence; identical to SEQ ID NO: 40647
  hemagglutinin__InfluenzaA__AIL93776

SEQ ID NO: 43099 - RNA, 1701 nt, Artificial Sequence
  hemagglutinin__InfluenzaA__AIL93788
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauacguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcagcugagggaaaaugcugaggauaugggcaaugguuguuucaaaauauaccacaaaugugacaaugccugcauaggaucaaucagaaauggaacuuaugaccacgauguauacagggaugaggcauugaacaaccgguuccagaucaagggaguugaguugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43100 - RNA, 1701 nt, Artificial Sequence; identical to SEQ ID NO: 40647
  hemagglutinin__InfluenzaA__AIL93812

SEQ ID NO: 43101 - RNA, 1701 nt, Artificial Sequence; identical to SEQ ID NO: 40647
  hemagglutinin__InfluenzaA__AIL93824

SEQ ID NO: 43102 - RNA, 1701 nt, Artificial Sequence
  hemagglutinin__InfluenzaA__AIL93836
augaaggcaauacuaguaguucuacuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauccaccauccaucuacuacugcugaccaacaaagucucuaucagaaugcagaugcauauguuuuuguggggacaucaagauacagcaaaaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaagugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaccaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaagaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaauguagaauauguauuuaa

SEQ ID NO: 43103 - RNA, 1701 nt, Artificial Sequence
  hemagglutinin__InfluenzaA__AIL93847
augaaggcaauacuaguaguucuacuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcuccgugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauccaccauccaucuacuacugcugaccaacaaagucucuaucagaaugcagaugcauauguuuuuguggggacaucaagauacagcaaaaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaagugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaccaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaagaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucugcuucuggaugugcucuaaugggucucuacaauguagaauauguauuuaa

SEQ ID NO: 43104 - RNA, 1701 nt, Artificial Sequence
  hemagglutinin__InfluenzaA__AIL93858
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaucgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucagauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugccccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaggcauugaacaaccgguuccagaucaagggaguugaguugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43105 - RNA, 1701 nt, Artificial Sequence
  hemagglutinin__InfluenzaA__AIL93870
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcagcugagggaaaaugcugaggauaugggcaaugguuguuucaaaauauaccacaaaugugacaaugccugcauaggaucaaucagaaauggaacuuaugaccacgauguauacagggaugaggcauugaacaaccgguuccagaucaagggaguugaguugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43106 - RNA, 1701 nt, Artificial Sequence
  hemagglutinin__InfluenzaA__AIL93882
augaagacuaucauugcuuugagcuacauucuaugucugguuuucgcucaaaaaccuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucagaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugaguugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43107 - RNA, 1701 nt, Artificial Sequence
  hemagglutinin__InfluenzaA__AIL93894
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaggcauugaacaaccgguuccagaucaagggaguugaguugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43108 - RNA, 1701 nt, Artificial Sequence
  hemagglutinin__InfluenzaA__AIL93906
augaaggcaauacuaguaguucugcuauacacauuugcaaccgcaaaugcagacacauuauguauagguuaucaugcgaacaauucaacagacacuguagacacaguacuagaaaagaauguaacaguaacacacucuauuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccgggagauuucaucaauuaugaggagcuaagagagcaauugagcucagugucgucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaaaauacagcaagaaguucaagccggaaauagcaauaagacccaaagugagggaucaagaagggagaaugaacuauuacuggacacuaauagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaucaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 43109 - RNA, 1701 nt, Artificial Sequence
  hemagglutinin__InfluenzaA__AIL93917
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacagaccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaaaugagggaaaaugcugaggauaugggcaaugguuguuucaaaauauaccacaaaugugacaaugccugcauaggaucaaucagaaauggaacuuaugaccacgauguauacagggaugaggcauugaacaaccgguuccagaucaagggaguugaguugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43110 - RNA, 1701 nt, Artificial Sequence
  hemagglutinin__InfluenzaA__AIL93929
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaacgagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccgaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43111 - RNA, 1701 nt, Artificial Sequence
  hemagglutinin__InfluenzaA__AIL93940
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguauccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauaugguuaguuaaaaaaggaaauucauacccaaagcucagccaauccuacauuaaugauaaagggaaagaaguccucgugcuguggggcauucaccaccccucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaucacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43112 - RNA, 1701 nt, Artificial Sequence; identical to SEQ ID NO: 43107
  hemagglutinin__InfluenzaA__AIL93951

SEQ ID NO: 43113 - RNA, 1701 nt, Artificial Sequence
  hemagglutinin__InfluenzaA__AIL93963
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguccaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaggcauugaacaaccgguuccagaucaagggaguugaguugaaaucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43114 - RNA, 1701 nt, Artificial Sequence
  hemagglutinin__InfluenzaA__AIL93975
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcugugaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43115 - RNA, 1701 nt, Artificial Sequence
  hemagglutinin__InfluenzaA__AIL93987
augaaggcaauacuaguaguucuacuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucuuacccaaagcucagccaauccuacauuaaugauaaagggaaagaaguccucgugcuguggggcauccaccauccaucuacuacugcugaccaacaaagucucuaucagaaugcagaugcauauguuuuuguggggacaucaagauacagcaaaaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaagugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagacggaugguacgguuaucaccaccaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuugaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaagaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaauguagaauauguauuuaa

SEQ ID NO: 43116 - RNA, 1701 nt, Artificial Sequence; identical to SEQ ID NO: 40647
  hemagglutinin__InfluenzaA__AIL93998

SEQ ID NO: 43117 - RNA, 1701 nt, Artificial Sequence; identical to SEQ ID NO: 43088
  hemagglutinin__InfluenzaA__AIL94010

SEQ ID NO: 43118 - RNA, 1701 nt, Artificial Sequence; identical to SEQ ID NO: 43104
  hemagglutinin__InfluenzaA__AIL94022

SEQ ID NO: 43119 - RNA, 1701 nt, Artificial Sequence
  hemagglutinin__InfluenzaA__AIL94046
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacagaccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaaccuaugaccacgauguauacagggaugaggcauugaacaaccgguuccagaucaagggaguugaguugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43120 - RNA, 1701 nt, Artificial Sequence
  hemagglutinin__InfluenzaA__AIL94058
augaaggcaauacuaguaguucuacuauauacauuugcacccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauccaccauccaucuacuacugcugaccaacaaagucucuaucagaaugcagaugcauauguuuuuguggggacaucaagauacagcaaaaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauagaaagaagugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauuaaggaaugucccgucuauucaaucuagaggccuauucggggccauugccggcuucauugaagggggguggacagggaugguagauggaugguacgguuaucaccaccaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaagaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaauguagaauauguauuuaa

SEQ ID NO: 43121 - RNA, 1701 nt, Artificial Sequence; identical to SEQ ID NO: 43091
  hemagglutinin__InfluenzaA__AIL94069

SEQ ID NO: 43122 - RNA, 1701 nt, Artificial Sequence
  hemagglutinin__InfluenzaA__AIL94080
augaaggcaauacuaguaguucuacuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauccaccauccaucuacuacugcugaccaacaaagucucuaucagaaugcagaugcauauguuuuuguggggacaucaagauacagcaaaaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaccaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaagaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaauguagaauauguauuuaa

SEQ ID NO: 43123 - RNA, 1701 nt, Artificial Sequence; identical to SEQ ID NO: 43088
  hemagglutinin__InfluenzaA__AIL94235

SEQ ID NO: 43124 - RNA, 1701 nt, Artificial Sequence; identical to SEQ ID NO: 40578
  hemagglutinin__InfluenzaA__AIL94247

SEQ ID NO: 43125 - RNA, 1701 nt, Artificial Sequence
  hemagglutinin__InfluenzaA__AIL94258
augaagacuaucauugcuuugagcuacauucuaugucugguuuucacucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugauugggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugaguugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43126 - RNA, 1701 nt, Artificial Sequence
  hemagglutinin__InfluenzaA__AIL94270
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagucaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugaguugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43127 - RNA, 1701 nt, Artificial Sequence; identical to SEQ ID NO: 40647
  hemagglutinin__InfluenzaA__AIL94282

SEQ ID NO: 43128 - RNA, 1701 nt, Artificial Sequence; identical to SEQ ID NO: 43105
  hemagglutinin__InfluenzaA__AIL94294

SEQ ID NO: 43129 - RNA, 1701 nt, Artificial Sequence
  hemagglutinin__InfluenzaA__AIL94306
augaagaccaucacugcuuugagcuacauucuaugucuggcuuucgcccaaaaaccuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccgaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaggcauugaacaaccgguuccagaucaagggaguugaguugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43130 - RNA, 1701 nt, Artificial Sequence
  hemagglutinin__InfluenzaA__AIL94318
augaagacuaucauugcuuugagcuacauucuaugucugguuuucgcucaaaaacuuccuggaaaugacaauagcacggcaacacugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcugugaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucuaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43131 - RNA, 1701 nt, Artificial Sequence
  hemagglutinin__InfluenzaA__AIL94330
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaacaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaaggaauauuccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaaugggagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggaggggaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43132 - RNA, 1701 nt, Artificial Sequence
  hemagglutinin__InfluenzaA__AIL94354
augaaggcaauacuaguaguucugcuauauacauuugcaaccgcaaaugcagacacauuauguauagguuaucaugcgaacaauucaacagacacuguagauacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauccaccauccaucuacuacugcugaccaacaaagucucuaucagaaugcagaugcauauguuuuuguggggacaucaagauacagcaaaaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaauguagaauauguauuuaa

SEQ ID NO: 43133 - RNA, 1701 nt, Artificial Sequence
  hemagglutinin__InfluenzaA__AIL94365
augaagacuaucauugcuuugagcuacauucuaugucugguuuucgcucaaaaacucccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugaguugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43134 - RNA, 1701 nt, Artificial Sequence
  hemagglutinin__InfluenzaA__AIL94377
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucauugugauggcuuucaaaauaagaaaugggaccuuuuuguugagcgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaggcauugaacaaccgguuccagaucaagggaguugaguugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43135 - RNA, 1701 nt, Artificial Sequence
  hemagglutinin__InfluenzaA__AIL94389
augaaggcaauacuaguaguucugcuauauacauuugcaaccgcaaaugcagacacauuauguauagguuaucaugcgaacaauucaacagacacuguagauacaguacuagaaaagaauguaacaguaacacacucuguuaaccuucuagaagacaagcauaacgggaaacuaugcaaacuaagagggguagccccauugcauuuggguaaauguaacauugcuggcuggaucuugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauccaccauccaucuacuacugcugaccaacaaagucucuaucagaaugcagaugcauauguuuuuguggggacaucaagauacagcaaaaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugauucuauuggaaaaugaaagaacuuuggacuaccaugauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaauguagaauuuguauuuaa

SEQ ID NO: 43136 - RNA, 1701 nt, Artificial Sequence
  hemagglutinin__InfluenzaA__AIL94411
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcaggcuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcacuaaacaaccgguuccagaucaagggaguugaguugaagucaggguacaaagauuggauccuauggauuuccuuugccauaucauguuuuuugcuuuguguugcuuuguugggguucaucaugugggccugccaaaagggcaacaucaggugcaacauuugcauuuga

SEQ ID NO: 43137 - RNA, 1701 nt, Artificial Sequence; identical to SEQ ID NO: 40647
  hemagglutinin__InfluenzaA__AIL94423

SEQ ID NO: 43138 - RNA, 1701 nt, Artificial Sequence
  hemagglutinin__InfluenzaA__AIL94435
augaaggcaauacuaguaguucuacuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauccaccauccaucuacuacugcugaccaacaaagucucuaucagaaugcagaugcauauguuuuuguggggacaucaagauacagcaaaaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaagugcuggaucugguauuaucauuucagauacaccaguccacgauugcaauacaacuugucagacacccgagggugcuauaaacaccagccucccauuucagaauauacauccgaucacaauuggaaaauguccaaaguacguaaaaagcacaaaauugagacuggccacaggauugaggaaugucccguccauucaaucuagaggccuauucggggccauugccggcuucauugaagggggguggacagggaugguagauggaugguacgguuaucaccaccaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaagaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaauguagaauauguauuuaa

SEQ ID NO: 43139 - RNA, 1701 nt, Artificial Sequence
  hemagglutinin__InfluenzaA__AIL94446
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaauuuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugaguugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43140 - RNA, 1701 nt, Artificial Sequence
  hemagglutinin__InfluenzaA__AIL94458
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggacuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaggcauugaacaaccgguuccagaucaagggaguugaguugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43141 - RNA, 1701 nt, Artificial Sequence
  hemagglutinin__InfluenzaA__AIL94470
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggaacuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccagcccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcgaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43142 - RNA, 1701 nt, Artificial Sequence
  hemagglutinin__InfluenzaA__AIL94481
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggaguuacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaaccagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugaguugaagucaggguacaaagauuggaucauauggauuuccuuugccauaucauguuuuuugcuuuguguugcuuuguugggguucaucaugugggccugccaaaagggcaacauuaggugcaacauuugcauuuga

SEQ ID NO: 43143 - RNA, 1701 nt, Artificial Sequence
  hemagglutinin__InfluenzaA__AIL94493
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauccaccauccaucuacuacugcugaccaacaaagucucuaucagaaugcagaugcauauguuuuuguggggacaucaagauacagcaaaaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaaaaaaugcuggaucugguauuaucauuucagauacaccaguccacgauugcaauacaacuugucagacacccgagggugcuauaaacaccagcuucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaauguagaauauguauuuaa

SEQ ID NO: 43144 - RNA, 1701 nt, Artificial Sequence; identical to SEQ ID NO: 43091
  hemagglutinin__InfluenzaA__AIL94504

SEQ ID NO: 43145 - RNA, 1701 nt, Artificial Sequence
  hemagglutinin__InfluenzaA__AIL94515
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggagcaauagcggguuucauagaaaaugguugggagggaaugguggaugguugguacgguuucaggcaucaaaacucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugaguugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43146 - RNA, 1701 nt, Artificial Sequence; identical to SEQ ID NO: 40647
  hemagglutinin__InfluenzaA__AIL94527

SEQ ID NO: 43147 - RNA, 1701 nt, Artificial Sequence
  hemagglutinin__InfluenzaA__AIL94539
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauccaccauccaucuacuacugcugaccaacaaagucucuaucagaaugcagaugcauauguuuuuguggggacaucaagauacagcaaaaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccagcccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaguuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaauguagaauauguauuuaa

SEQ ID NO: 43148 - RNA, 1701 nt, Artificial Sequence
  hemagglutinin__InfluenzaA__AIL94550
augaaggcaauacuaguaguucuacuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaaacucagccaauccuacauuaaugauaaagggaaagaaguccucgugcuguggggcauccaccauccaucuacuacugcugaccaacaaagucucuaucagaaugcagaugcauauguuuuuguggggacaucaagauacagcaaaaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaagugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaccaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaagaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaauguagaauauguauuuaa

SEQ ID NO: 43149 - RNA, 1701 nt, Artificial Sequence
  hemagglutinin__InfluenzaA__AIL94561
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaggcauugaacaaccgguuccagaucaagggaguugaguugaagucaggguacaaagauuggauccuauggauuuccuuugccauaucauguuuuuugcuuuguguugcuuuguugggguucaucaugugggccugccaaaggggcaacauuaggugcaacauuugcauuuga

SEQ ID NO: 43150 - RNA, 1701 nt, Artificial Sequence
  hemagglutinin__InfluenzaA__AIL94573
augaaggcaauacuaguaguucuacuauauacauuugcaaccgcaaaugcagacacauuauguauagguuaucaugcgaacaauucaacagacacuguagacacaguacuagaaaagaauguaauaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauccaccauccaucuacuacugcugaccaacaaagucucuaucagaaugcagaugcauauguuuuuguggggacaucaagauacagcaaaaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaccaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaagaaugggacuuaugacuacccaaaauacucagaggaagcaaaauuaaacagagaaaaaauagaugggguaaagcuggaaucaacaaggguuuaccagauuuuggcgaucuauucaacugucgccaguucauugguacugguagucucccugggggcaaucagcuucuggaugugcucuaaugggucucuacaauguagaauauguauuuaa

SEQ ID NO: 43151 - RNA, 1701 nt, Artificial Sequence
  hemagglutinin__InfluenzaA__AIL94584
augaaggcaauacuaguaguucugcuauauacauuugcaaccgcaaaugcagacacauuauguauagguuaucaugcgaacaauucaacagacacuguagacacaguacuagaaaagaauauaacaguaacacacucuguuaaccuucuagaagacaagcauaacgggaaacuaugcaaacuaagagggguagccccauugcauuuggguaaauguaacauugcuggauggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauccaccauccaucuacuacugcugaccaacaaagucucuaucagaaugcagaugcauauguuuuuguggggacaucaagauacagcaaaaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaagauguccaaaguauguaaaaagcacaaaauugagacuggccacaggauugaggaaugucccgucuauucaaucuagaggucuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaauguagaauauguauuuaa

SEQ ID NO: 43152 - RNA, 1701 nt, Artificial Sequence
  hemagglutinin__InfluenzaA__AIL94595
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauccaccauccaucuacuacuacugaccaacaaagucucuaucagaaugcagaugcauauguuuuuguggggacaucaagauacagcaaaaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaaaaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaauguagaauauguauuuaa

SEQ ID NO: 43153 - RNA, 1701 nt, Artificial Sequence; identical to SEQ ID NO: 40647
  hemagglutinin__InfluenzaA__AIL94606

SEQ ID NO: 43154 - RNA, 1701 nt, Artificial Sequence; identical to SEQ ID NO: 43132
  hemagglutinin__InfluenzaA__AIL94618

SEQ ID NO: 43155 - RNA, 1701 nt, Artificial Sequence
  hemagglutinin__InfluenzaA__AIL94629
augaaggcaauacuaguaguucuacuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaagagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauccaccauccaucuacuacugcugaccaacaaagucucuaucagaaugcagaugcauauguuuuuguggggacaucaagauacagcaaaaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaagugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaccaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaagaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaauguagaauauguauuuaa

SEQ ID NO: 43156 - RNA, 1701 nt, Artificial Sequence; identical to SEQ ID NO: 40647
  hemagglutinin__InfluenzaA__AIL94640

SEQ ID NO: 43157 - RNA, 1701 nt, Artificial Sequence
  hemagglutinin__InfluenzaA__AIL94652
augaaggcaauacuaguaguucugcuauacacauuugcaaccgcaaaugcagacacauuauguauagguuaucaugcgaacaauucaacagacacuguagacacaguacuagaaaagaauguaacaguaacacacucuauuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaaaauacagcaagaaguucaagccggaaauagcaauaagacccaaagugagggaucaagaagggagaaugaacuauuacuggacacuaauagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaucaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuagacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 43158 - RNA, 1701 nt, Artificial Sequence; identical to SEQ ID NO: 43132
  hemagglutinin__InfluenzaA__AIL94663

SEQ ID NO: 43159 - RNA, 1701 nt, Artificial Sequence; identical to SEQ ID NO: 43132
  hemagglutinin__InfluenzaA__AIL94674

SEQ ID NO: 43160 - RNA, 1701 nt, Artificial Sequence
  hemagglutinin__InfluenzaA__AIL94697
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcaggcuucauagaaaaugguugggagggaaugguggaugguugguacgguuucagacaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcacuaaacaaccgguuccagaucaagggaguugaguugaagucaggguacaaagauuggauccuauggauuuccuuugccauaucauguuuuuugcuuuguguugcuuuguugggguucaucaugugggccugccaaaagggcaacaucaggugcaacauuugcauuuga

SEQ ID NO: 43161 - RNA, 1701 nt, Artificial Sequence; identical to SEQ ID NO: 43122
  hemagglutinin__InfluenzaA__AIL94709

SEQ ID NO: 43162 - RNA, 1701 nt, Artificial Sequence
  hemagglutinin__InfluenzaA__AIL94720
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauccaccauccaucuacuacugcugaccaacaaagucucuaucagaaugcagaugcauauguuuuuguggggacaucaagauacagcaaaaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaacuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaauguagaauauguauuuaa

SEQ ID NO: 43163 - RNA, 1701 nt, Artificial Sequence; identical to SEQ ID NO: 43136
  hemagglutinin__InfluenzaA__AIL94731

SEQ ID NO: 43164 - RNA, 1701 nt, Artificial Sequence
  hemagglutinin__InfluenzaA__AIL94743
augaaggcaauacuaguaguucuacuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguagaaacaucuaguucagacaauggaacguguuacccaggagauuucaucaauuaugaagaguuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauccaccauccaucuacuacugcugaccaacaaagucucuaucagaaugcagaugcauauguuuuuguggggacaucaagauacagcaaaaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaagugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaccaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaguuuuaccacaaaugcgauaacacgugcauggaaagugucaagaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaauguagaauauguauuuaa

SEQ ID NO: 43165 - RNA, 1701 nt, Artificial Sequence
  hemagglutinin__InfluenzaA__AIL94754
augaaggcaauacuaguaguucugcuauauacauuugcaaccgcaaaugcagacacauuauguauagguuaucaugcgaacaauucaacagacacuguagauacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauccaccauccaucuacuacugcugaccaacaaagucucuaucagaaugcagaugcauauguuuuuguggggacaucaagauacagcaaaaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugauucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugccaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaauguagaauauguauuuaa

SEQ ID NO: 43166 - RNA, 1701 nt, Artificial Sequence
  hemagglutinin__InfluenzaA__AIL94765
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacagaccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaggcauugaacaaccgguuccagaucaagggaguugaguugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43167 - RNA, 1701 nt, Artificial Sequence; identical to SEQ ID NO: 40647
  hemagglutinin__InfluenzaA__AIL94777

SEQ ID NO: 43168 - RNA, 1701 nt, Artificial Sequence
  hemagglutinin__InfluenzaA__AIL94789
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauccaccauccaucuacuacugcugaccaacaaagucucuaucagaaugcagaugcauauguuuuuguggggacaucaagauacagcaaaaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaauaucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaauguagaauauguauuuaa

SEQ ID NO: 43169 - RNA, 1701 nt, Artificial Sequence
  hemagglutinin__InfluenzaA__AIL94800
augaaggcaauacuaguaguucugcuauauacauuugcaaccgcaaaugcagacacauuauguauagguuaucaugcgaacaauucaacagacacuguagauacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauccaccauccaucuacuacugcugaccaacaaagucucuaucagaaugcagaugcauauguuuuuguggggacaucaagauacagcaaaaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguaugugaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaauguagaauauguauuuaa

SEQ ID NO: 43170 - RNA, 1701 nt, Artificial Sequence
  hemagglutinin__InfluenzaA__AIL94811
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcugugaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43171 - RNA, 1701 nt, Artificial Sequence
  hemagglutinin__InfluenzaA__AIL94823
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaacaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaaggaauauuccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggaggggaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43172 - RNA, 1701 nt, Artificial Sequence
  hemagglutinin__InfluenzaA__AIL94835
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuacucaauaggugaaauaugcgacaguccucaucagauccuugauggagagaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaggcauugaacaaccgguuccagaucaagggaguugaguugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43173 - RNA, 1701 nt, Artificial Sequence
  hemagglutinin__InfluenzaA__AIL94847
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacgaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucaaauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43174 - RNA, 1701 nt, Artificial Sequence; identical to SEQ ID NO: 36037
  hemagglutinin__InfluenzaA__AIL94859

SEQ ID NO: 43175 - RNA, 1701 nt, Artificial Sequence
  hemagglutinin__InfluenzaA__AIL94871
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaaguggaaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucacaauauaccacaaaugugacaaugccugcauaggaucaaucagaaauggaacuuaugaccacaauguauacagagaugaagcauuaaacaaccgguuccagaucaagggaauugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43176 - RNA, 1701 nt, Artificial Sequence; identical to SEQ ID NO: 42585
  hemagglutinin__InfluenzaA__AIL94883

SEQ ID NO: 43177 - RNA, 1701 nt, Artificial Sequence; identical to SEQ ID NO: 42569
  hemagglutinin__InfluenzaA__AIL94894

SEQ ID NO: 43178 - RNA, 1701 nt, Artificial Sequence; identical to SEQ ID NO: 43171
  hemagglutinin__InfluenzaA__AIL94906

SEQ ID NO: 43179 - RNA, 1701 nt, Artificial Sequence; identical to SEQ ID NO: 40647
  hemagglutinin__InfluenzaA__AIL94918

SEQ ID NO: 43180 - RNA, 1701 nt, Artificial Sequence
  hemagglutinin__InfluenzaA__AIL94930
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagucaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugaguugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43181 - RNA, 1701 nt, Artificial Sequence
  hemagglutinin__InfluenzaA__AIL94942
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauuaggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacggggaaucuaauugcuccuagggguuacuucaaaauacgaaguggaaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaaguacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaggcauugaacaaccgguuccagaucaagggaguugaguugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43182 - RNA, 1701 nt, Artificial Sequence
  hemagglutinin__InfluenzaA__AIL94954
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggauggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauccaccauccaucuacuacugcugaccaacaaagucucuaucagaaugcagaugcauauguuuuuguggggacaucaagauacagcaaaaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaauguagaauauguauuuaa

SEQ ID NO: 43183 - RNA, 1701 nt, Artificial Sequence; identical to SEQ ID NO: 43171
  hemagglutinin__InfluenzaA__AIL94965

SEQ ID NO: 43184 - RNA, 1701 nt, Artificial Sequence
  hemagglutinin__InfluenzaA__AIM55837
augaaggcaauacuaguaguucugcuauauacauuugcaaccgcaacugcagacacauuauguauagguuaucaugcaaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaaaacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagucuggccacaggauugaggaaugucccgucuauucaaucuagaggccuauucggggccauugccggcuucauugaagggggauggacagggaugguagauggaugguacgguuaucaccaucaaaaugagcaggggucaggauaugcagccgaccugaagagcacacaaaaugccauugacaagauuacuaacaaaguaaacucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugugauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43185 - RNA, 1701 nt, Artificial Sequence
  hemagglutinin__InfluenzaA__AIM55848
augaaggcaauacuaguaguucugcuauauacauuugcaaccgcaaaugcagacacuuuauguauagguuaucaugcgaacaauucaacagacacuguagacacaguacuagaaaagaauguaacaguaacacacucuguuaaccuucuagaagacaagcauaacgguaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagucaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggcaacaggauugaggaauaucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaacucuguuauugaaaagaugaauacacaguucacagcaguggguaaagaguucaaccaccuggaaaaaagaauagagaauuuaaauaaaaaaguugaugaugguuuccuggacauuuggacuuacaauaccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43186 - RNA, 1701 nt, Artificial Sequence; identical to SEQ ID NO: 41497
  hemagglutinin__InfluenzaA__AIM55859

SEQ ID NO: 43187 - RNA, 1701 nt, Artificial Sequence
  hemagglutinin__InfluenzaA__AIM55870
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaagagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaaacuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43188 - RNA, 1701 nt, Artificial Sequence; identical to SEQ ID NO: 43187
  hemagglutinin__InfluenzaA__AIM55881

SEQ ID NO: 43189 - RNA, 1701 nt, Artificial Sequence
  hemagglutinin__InfluenzaA__AIM55893
augaaggcaauacuaguaguucugcuauauacauuugcaaccgcaaaugcagacacuuuauguauagguuaucaugcgaacaauucaacagacacuguagacacaguacuagaaaagaauguaacaguaacacacucuguuaaccuucuagaagacaagcauaacgguaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagucaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccaggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggcaacaggauugaggaauaucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaacucuguuauugaaaagaugaauacacaguucacagcaguggguaaagaguucaaccaccuggaaaaaagaauugagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43190 - RNA, 1701 nt, Artificial Sequence
  hemagglutinin__InfluenzaA__AIM55904
augaaggcaauacuaguaguucugcuauauacauuugcaaccacaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguaucaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugcaaaggaaauuggaaacggaugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43191 - RNA, 1701 nt, Artificial Sequence
  hemagglutinin__InfluenzaA__AIM55915
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacauccaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacaggaaugguagauggaugguacgguuaucaccaucaaaacgagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacgguugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa
